United States Patent 7,696,342 (BIOINFORMATICALLY DETECTABLE GROUP OF NOVEL VIRAL REGULATORY GENES AND USES THEREOF) - sequence listing, part 2

SEQ ID NO: 36538 - RNA, 22 nt, Homo sapiens
aggagaccuauuaggcaaaaua

SEQ ID NO: 36539 - RNA, 18 nt, Homo sapiens
aguugguuagagaagguu

SEQ ID NO: 36540 - RNA, 22 nt, Homo sapiens
auaugaaggacuaaauuaccaa

SEQ ID NO: 36541 - RNA, 18 nt, Homo sapiens
cccuucugagaauuugca

SEQ ID NO: 36542 - RNA, 23 nt, Homo sapiens
ccuuggccucccaaaauguuggg

SEQ ID NO: 36543 - RNA, 18 nt, Homo sapiens
cgucagucccauucugcu

SEQ ID NO: 36544 - RNA, 16 nt, Homo sapiens
cugaucauuuuaucac

SEQ ID NO: 36545 - RNA, 19 nt, Homo sapiens
cugugaucuuguauacuua

SEQ ID NO: 36546 - RNA, 21 nt, Homo sapiens
gagagagagagagagaaagag

SEQ ID NO: 36547 - RNA, 19 nt, Homo sapiens
gagagcuuguacucugaga

SEQ ID NO: 36548 - RNA, 20 nt, Homo sapiens
gggaacuuucugcagauuuc

SEQ ID NO: 36549 - RNA, 15 nt, Homo sapiens
guaggcuagcacacc

SEQ ID NO: 36550 - RNA, 19 nt, Homo sapiens
uaagguguucacagcccuu

SEQ ID NO: 36551 - RNA, 19 nt, Homo sapiens
uacagcacccccuuugcuc

SEQ ID NO: 36552 - RNA, 14 nt, Homo sapiens
uccaaccucucacu

SEQ ID NO: 36553 - RNA, 25 nt, Homo sapiens
ugaugacauaguaaaugcuuaguaa

SEQ ID NO: 36554 - RNA, 15 nt, Homo sapiens
uggaggacuuagggc

SEQ ID NO: 36555 - RNA, 18 nt, Homo sapiens
ugguuuucaaguguuaug

SEQ ID NO: 36556 - RNA, 21 nt, Homo sapiens
uucauguuugcuaaugaccuc

SEQ ID NO: 36557 - RNA, 17 nt, Homo sapiens
uugggaggccgaggugg

SEQ ID NO: 36558 - RNA, 17 nt, Homo sapiens
uugggaggcugaggcgg

SEQ ID NO: 36559 - RNA, 17 nt, Homo sapiens
uuguauucauauuucuc

SEQ ID NO: 36560 - RNA, 20 nt, Homo sapiens
uuguauucauauuucucuuu

SEQ ID NO: 36561 - RNA, 18 nt, Homo sapiens
uuuaaaaaaacagauuuc

SEQ ID NO: 36562 - RNA, 16 nt, Homo sapiens
agaaaagagagagaga

SEQ ID NO: 36563 - RNA, 18 nt, Homo sapiens
agaauuucaaagcauucu

SEQ ID NO: 36564 - RNA, 21 nt, Homo sapiens
gagagagagagagagaaagag

SEQ ID NO: 36565 - RNA, 20 nt, Homo sapiens
gggaacuuucugcagauuuc

SEQ ID NO: 36566 - RNA, 15 nt, Homo sapiens
guaggcuagcacacc

SEQ ID NO: 36567 - RNA, 14 nt, Homo sapiens
uccaaccucucacu

SEQ ID NO: 36568 - RNA, 18 nt, Homo sapiens
uugguuagagaagguugu

SEQ ID NO: 36569 - RNA, 17 nt, Homo sapiens
uuguauucauauuucuc

SEQ ID NO: 36570 - RNA, 20 nt, Homo sapiens
uuguauucauauuucucuuu

SEQ ID NO: 36571 - RNA, 24 nt, Homo sapiens
aacgguggcauccgguaugaugga

SEQ ID NO: 36572 - RNA, 16 nt, Homo sapiens
agaaaagagagagaga

SEQ ID NO: 36573 - RNA, 18 nt, Homo sapiens
agaauuucaaagcauucu

SEQ ID NO: 36574 - RNA, 20 nt, Homo sapiens
agggaacucaaagaaaaaau

SEQ ID NO: 36575 - RNA, 18 nt, Homo sapiens
aguugguuagagaagguu

SEQ ID NO: 36576 - RNA, 21 nt, Homo sapiens
gagagagagagagagaaagag

SEQ ID NO: 36577 - RNA, 20 nt, Homo sapiens
gggaacuuucugcagauuuc

SEQ ID NO: 36578 - RNA, 15 nt, Homo sapiens
guaggcuagcacacc

SEQ ID NO: 36579 - RNA, 19 nt, Homo sapiens
uacaguaccagauucuuca

SEQ ID NO: 36580 - RNA, 14 nt, Homo sapiens
uccaaccucucacu

SEQ ID NO: 36581 - RNA, 18 nt, Homo sapiens
uucuucccccaaauauuu

SEQ ID NO: 36582 - RNA, 22 nt, Homo sapiens
uuggguuucuucccccaaauau

SEQ ID NO: 36583 - RNA, 18 nt, Homo sapiens
uugguuagagaagguugu

SEQ ID NO: 36584 - RNA, 17 nt, Homo sapiens
uuguauucauauuucuc

SEQ ID NO: 36585 - RNA, 20 nt, Homo sapiens
uuguauucauauuucucuuu

SEQ ID NO: 36586 - RNA, 19 nt, Homo sapiens
cacacuucuguaaacagag

SEQ ID NO: 36587 - RNA, 21 nt, Homo sapiens
cauuagggcggaaagaguggg

SEQ ID NO: 36588 - RNA, 18 nt, Homo sapiens
ccgcuccaccuucuaccc

SEQ ID NO: 36589 - RNA, 18 nt, Homo sapiens
gcccgagacucguggggc

SEQ ID NO: 36590 - RNA, 18 nt, Homo sapiens
uaucuuacgcugauauuc

SEQ ID NO: 36591 - RNA, 19 nt, Homo sapiens
ugcccgagacucguggggc

SEQ ID NO: 36592 - RNA, 19 nt, Homo sapiens
uucguuccgcaaugcaugu

SEQ ID NO: 36593 - RNA, 16 nt, Homo sapiens
agaaaagagagagaga

SEQ ID NO: 36594 - RNA, 18 nt, Homo sapiens
agaauuucaaagcauucu

SEQ ID NO: 36595 - RNA, 18 nt, Homo sapiens
aguugguuagagaagguu

SEQ ID NO: 36596 - RNA, 21 nt, Homo sapiens
gagagagagagagagaaagag

SEQ ID NO: 36597 - RNA, 20 nt, Homo sapiens
gggaacuuucugcagauuuc

SEQ ID NO: 36598 - RNA, 15 nt, Homo sapiens
guaggcuagcacacc

SEQ ID NO: 36599 - RNA, 17 nt, Homo sapiens
uuguauucauauuucuc

SEQ ID NO: 36600 - RNA, 20 nt, Homo sapiens
uuguauucauauuucucuuu

SEQ ID NO: 36601 - RNA, 16 nt, Homo sapiens
agaaaagagagagaga

SEQ ID NO: 36602 - RNA, 18 nt, Homo sapiens
agaauuucaaagcauucu

SEQ ID NO: 36603 - RNA, 18 nt, Homo sapiens
aguugguuagagaagguu

SEQ ID NO: 36604 - RNA, 21 nt, Homo sapiens
gagagagagagagagaaagag

SEQ ID NO: 36605 - RNA, 20 nt, Homo sapiens
gggaacuuucugcagauuuc

SEQ ID NO: 36606 - RNA, 15 nt, Homo sapiens
guaggcuagcacacc

SEQ ID NO: 36607 - RNA, 14 nt, Homo sapiens
uccaaccucucacu

SEQ ID NO: 36608 - RNA, 17 nt, Homo sapiens
uuguauucauauuucuc

SEQ ID NO: 36609 - RNA, 20 nt, Homo sapiens
uuguauucauauuucucuuu

SEQ ID NO: 36610 - RNA, 21 nt, Homo sapiens
agggcaaugguuaaaucauuu

SEQ ID NO: 36611 - RNA, 18 nt, Homo sapiens
cuccaaaucucggguucu

SEQ ID NO: 36612 - RNA, 21 nt, Homo sapiens
gaaaauguccauuuuccccau

SEQ ID NO: 36613 - RNA, 19 nt, Homo sapiens
ucccaggugaaaucugugu

SEQ ID NO: 36614 - RNA, 18 nt, Homo sapiens
ucucccaggugaaaucug

SEQ ID NO: 36615 - RNA, 21 nt, Homo sapiens
aauuuuugcccuuguuucuca

SEQ ID NO: 36616 - RNA, 16 nt, Homo sapiens
agaaaagagagagaga

SEQ ID NO: 36617 - RNA, 18 nt, Homo sapiens
agaauuucaaagcauucu

SEQ ID NO: 36618 - RNA, 18 nt, Homo sapiens
aguugguuagagaagguu

SEQ ID NO: 36619 - RNA, 21 nt, Homo sapiens
gagagagagagagagaaagag

SEQ ID NO: 36620 - RNA, 20 nt, Homo sapiens
gggaacuuucugcagauuuc

SEQ ID NO: 36621 - RNA, 15 nt, Homo sapiens
guaggcuagcacacc

SEQ ID NO: 36622 - RNA, 14 nt, Homo sapiens
uccaaccucucacu

SEQ ID NO: 36623 - RNA, 17 nt, Homo sapiens
ugccggccgucacugcu

SEQ ID NO: 36624 - RNA, 18 nt, Homo sapiens
uugguuagagaagguugu

SEQ ID NO: 36625 - RNA, 17 nt, Homo sapiens
uuguauucauauuucuc

SEQ ID NO: 36626 - RNA, 20 nt, Homo sapiens
uuguauucauauuucucuuu

SEQ ID NO: 36627 - RNA, 16 nt, Homo sapiens
agaaaagagagagaga

SEQ ID NO: 36628 - RNA, 18 nt, Homo sapiens
agaauuucaaagcauucu

SEQ ID NO: 36629 - RNA, 18 nt, Homo sapiens
aguugguuagagaagguu

SEQ ID NO: 36630 - RNA, 21 nt, Homo sapiens
gagagagagagagagaaagag

SEQ ID NO: 36631 - RNA, 20 nt, Homo sapiens
gggaacuuucugcagauuuc

SEQ ID NO: 36632 - RNA, 15 nt, Homo sapiens
guaggcuagcacacc

SEQ ID NO: 36633 - RNA, 14 nt, Homo sapiens
uccaaccucucacu

SEQ ID NO: 36634 - RNA, 18 nt, Homo sapiens
uugguuagagaagguugu

SEQ ID NO: 36635 - RNA, 17 nt, Homo sapiens
uuguauucauauuucuc

SEQ ID NO: 36636 - RNA, 20 nt, Homo sapiens
uuguauucauauuucucuuu

SEQ ID NO: 36637 - RNA, 17 nt, Homo sapiens
ccugcuccuccugcggc

SEQ ID NO: 36638 - RNA, 17 nt, Homo sapiens
cggcgccuucuguggcu

SEQ ID NO: 36639 - RNA, 18 nt, Homo sapiens
gcucuuuuugcggcugcg

SEQ ID NO: 36640 - RNA, 19 nt, Homo sapiens
ucuuugccaggaacuucau

SEQ ID NO: 36641 - RNA, 23 nt, Homo sapiens
caacauggcccuaggggacccac

SEQ ID NO: 36642 - RNA, 25 nt, Homo sapiens
ccaccucuuccuuuuucugggucua

SEQ ID NO: 36643 - RNA, 19 nt, Homo sapiens
ccagcccgguguccggugu

SEQ ID NO: 36644 - RNA, 24 nt, Homo sapiens
ccccgacgcccggccccggugcgg

SEQ ID NO: 36645 - RNA, 22 nt, Homo sapiens
ccgccgccccagcccggugucc

SEQ ID NO: 36646 - RNA, 14 nt, Homo sapiens
ccgccgcccgcgcc

SEQ ID NO: 36647 - RNA, 20 nt, Homo sapiens
ccgccucggccgccgccgcc

SEQ ID NO: 36648 - RNA, 23 nt, Homo sapiens
ccucccccacuggcucuuuuugu

SEQ ID NO: 36649 - RNA, 17 nt, Homo sapiens
cgccgccgccgccgccc

SEQ ID NO: 36650 - RNA, 17 nt, Homo sapiens
cgccucggccgccucgg

SEQ ID NO: 36651 - RNA, 18 nt, Homo sapiens
cgcgcguaaaaauagccc

SEQ ID NO: 36652 - RNA, 21 nt, Homo sapiens
cggccucccaaagugcugggg

SEQ ID NO: 36653 - RNA, 21 nt, Homo sapiens
cuccccacucuggauuucugu

SEQ ID NO: 36654 - RNA, 15 nt, Homo sapiens
cucccccucuccccu

SEQ ID NO: 36655 - RNA, 18 nt, Homo sapiens
gaggguaggugacaggcc

SEQ ID NO: 36656 - RNA, 19 nt, Homo sapiens
gaucacaggcaugugccac

SEQ ID NO: 36657 - RNA, 17 nt, Homo sapiens
gccccgccgccgccgcc

SEQ ID NO: 36658 - RNA, 17 nt, Homo sapiens
gcggccccgccucggcc

SEQ ID NO: 36659 - RNA, 23 nt, Homo sapiens
gcuauuuccuuuggguccuggug

SEQ ID NO: 36660 - RNA, 18 nt, Homo sapiens
ggacgcccgcccugcccu

SEQ ID NO: 36661 - RNA, 23 nt, Homo sapiens
uaaaugcaaaacagcccgaugug

SEQ ID NO: 36662 - RNA, 16 nt, Homo sapiens
ucuccccacucuggau

SEQ ID NO: 36663 - RNA, 19 nt, Homo sapiens
uuguugagacgggggcucc

SEQ ID NO: 36664 - RNA, 16 nt, Homo sapiens
agggguuuuaaaaccu

SEQ ID NO: 36665 - RNA, 22 nt, Homo sapiens
agguggaucacgaggucaggag

SEQ ID NO: 36666 - RNA, 20 nt, Homo sapiens
auaaauaauaagucguuuua

SEQ ID NO: 36667 - RNA, 22 nt, Homo sapiens
gacacugacgcuauuucuuaca

SEQ ID NO: 36668 - RNA, 14 nt, Homo sapiens
gauccagucuccug

SEQ ID NO: 36669 - RNA, 19 nt, Homo sapiens
gauggagguaaaccaagga

SEQ ID NO: 36670 - RNA, 20 nt, Homo sapiens
ugucuuauaugcuuuagguu

SEQ ID NO: 36671 - RNA, 17 nt, Homo sapiens
aagacacugugcuaggu

SEQ ID NO: 36672 - RNA, 16 nt, Homo sapiens
agucucagagcggcag

SEQ ID NO: 36673 - RNA, 15 nt, Homo sapiens
cagaggccuaaucuc

SEQ ID NO: 36674 - RNA, 18 nt, Homo sapiens
cuagaucuggugaucccc

SEQ ID NO: 36675 - RNA, 22 nt, Homo sapiens
cuggccagggggaggggaaugu

SEQ ID NO: 36676 - RNA, 21 nt, Homo sapiens
uaagaaaaagaaaugauaaag

SEQ ID NO: 36677 - RNA, 19 nt, Homo sapiens
uacagagagaaaaagauga

SEQ ID NO: 36678 - RNA, 21 nt, Homo sapiens
ugaaauauauucuuaaugguc

SEQ ID NO: 36679 - RNA, 20 nt, Homo sapiens
ugguauagaaugucagugau

SEQ ID NO: 36680 - RNA, 19 nt, Homo sapiens
uugaagggaagaaaggaau

SEQ ID NO: 36681 - RNA, 19 nt, Homo sapiens
ccacccuugucagaacacc

SEQ ID NO: 36682 - RNA, 22 nt, Homo sapiens
gcccucuuccuucuggguuucc

SEQ ID NO: 36683 - RNA, 16 nt, Homo sapiens
ggacgcgcgccugccu

SEQ ID NO: 36684 - RNA, 18 nt, Homo sapiens
aggaggaggcagggggag

SEQ ID NO: 36685 - RNA, 18 nt, Homo sapiens
agggaccaaugaaaagga

SEQ ID NO: 36686 - RNA, 17 nt, Homo sapiens
agguuggggagcucugg

SEQ ID NO: 36687 - RNA, 21 nt, Homo sapiens
gagcagguggagaacgaggga

SEQ ID NO: 36688 - RNA, 22 nt, Homo sapiens
gaggaggaggaggaggcagggg

SEQ ID NO: 36689 - RNA, 19 nt, Homo sapiens
gaggaggaggcagggggag

SEQ ID NO: 36690 - RNA, 20 nt, Homo sapiens
ggggaggagucauuugggag

SEQ ID NO: 36691 - RNA, 21 nt, Homo sapiens
gggggagcuccgaggggcggg

SEQ ID NO: 36692 - RNA, 16 nt, Homo sapiens
ugcccgaaccugcucu

SEQ ID NO: 36693 - RNA, 17 nt, Homo sapiens
acccugagguuuagaga

SEQ ID NO: 36694 - RNA, 20 nt, Homo sapiens
ccucugggguucagaggagg

SEQ ID NO: 36695 - RNA, 21 nt, Homo sapiens
cgggagcgaggagcggccugg

SEQ ID NO: 36696 - RNA, 17 nt, Homo sapiens
gagauugcuucuggggu

SEQ ID NO: 36697 - RNA, 14 nt, Homo sapiens
gagcggccuggggu

SEQ ID NO: 36698 - RNA, 18 nt, Homo sapiens
gggcgggagcgaggagcg

SEQ ID NO: 36699 - RNA, 20 nt, Homo sapiens
gggucgggaagggggaggag

SEQ ID NO: 36700 - RNA, 21 nt, Homo sapiens
ggucaaagggcucggugguug

SEQ ID NO: 36701 - RNA, 19 nt, Homo sapiens
uggggucgggaagggggag

SEQ ID NO: 36702 - RNA, 18 nt, Homo sapiens
aguguuugggacuugaaa

SEQ ID NO: 36703 - RNA, 21 nt, Homo sapiens
caaaagauauccucccacaag

SEQ ID NO: 36704 - RNA, 23 nt, Homo sapiens
ccuaauucccccuugggguuggg

SEQ ID NO: 36705 - RNA, 17 nt, Homo sapiens
cugggccucaugaaaug

SEQ ID NO: 36706 - RNA, 22 nt, Homo sapiens
gcauguacaccagcauuacaaa

SEQ ID NO: 36707 - RNA, 20 nt, Homo sapiens
ggcgauucuguucuacuucc

SEQ ID NO: 36708 - RNA, 20 nt, Homo sapiens
ugagccaaguguagcauugu

SEQ ID NO: 36709 - RNA, 18 nt, Homo sapiens
ccacgccaugcugaggug

SEQ ID NO: 36710 - RNA, 20 nt, Homo sapiens
ucucaggguugucgcaagua

SEQ ID NO: 36711 - RNA, 18 nt, Homo sapiens
ugcugugauuuccccucc

SEQ ID NO: 36712 - RNA, 21 nt, Homo sapiens
uguuuuaaagaaaguguguac

SEQ ID NO: 36713 - RNA, 20 nt, Homo sapiens
uucaacacaugcuuuauaga

SEQ ID NO: 36714 - RNA, 19 nt, Homo sapiens
ucuggggagcuggacuuug

SEQ ID NO: 36715 - RNA, 17 nt, Homo sapiens
cagccgcggccgccgcg

SEQ ID NO: 36716 - RNA, 18 nt, Homo sapiens
cagcuccgcagcuggagc

SEQ ID NO: 36717 - RNA, 18 nt, Homo sapiens
ccacagucaccaagagcc

SEQ ID NO: 36718 - RNA, 16 nt, Homo sapiens
cccccaccccuugggu

SEQ ID NO: 36719 - RNA, 16 nt, Homo sapiens
gcagccgcggccgccg

SEQ ID NO: 36720 - RNA, 19 nt, Homo sapiens
gcccccugccucucucugg

SEQ ID NO: 36721 - RNA, 18 nt, Homo sapiens
ggacaggacgcgggggcg

SEQ ID NO: 36722 - RNA, 20 nt, Homo sapiens
ggcgguagaaagagcacaga

SEQ ID NO: 36723 - RNA, 20 nt, Homo sapiens
gggacaggacgcgggggcgg

SEQ ID NO: 36724 - RNA, 23 nt, Homo sapiens
uggguguguggcugcaggaaggc

SEQ ID NO: 36725 - RNA, 14 nt, Homo sapiens
cacucacaagcugg

SEQ ID NO: 36726 - RNA, 18 nt, Homo sapiens
aaagccauauaaauauua

SEQ ID NO: 36727 - RNA, 19 nt, Homo sapiens
aggggcuggcaccaaacca

SEQ ID NO: 36728 - RNA, 18 nt, Homo sapiens
agugggguggggaggagg

SEQ ID NO: 36729 - RNA, 17 nt, Homo sapiens
cccgccgcccgcugccc

SEQ ID NO: 36730 - RNA, 16 nt, Homo sapiens
cuuccugcuggggcuc

SEQ ID NO: 36731 - RNA, 16 nt, Homo sapiens
ggagugggguggggag

SEQ ID NO: 36732 - RNA, 23 nt, Homo sapiens
gucugggguucucuggcagcccc

SEQ ID NO: 36733 - RNA, 20 nt, Homo sapiens
cagaaacauugaaaaaauga

SEQ ID NO: 36734 - RNA, 18 nt, Homo sapiens
aaagccauauaaauauua

SEQ ID NO: 36735 - RNA, 18 nt, Homo sapiens
agugggguggggaggagg

SEQ ID NO: 36736 - RNA, 17 nt, Homo sapiens
cccgccgcccgcugccc

SEQ ID NO: 36737 - RNA, 16 nt, Homo sapiens
cuuccugcuggggcuc

SEQ ID NO: 36738 - RNA, 16 nt, Homo sapiens
ggagugggguggggag

SEQ ID NO: 36739 - RNA, 23 nt, Homo sapiens
gucugggguucucuggcagcccc

SEQ ID NO: 36740 - RNA, 18 nt, Homo sapiens
ugaggaggagguggggga

SEQ ID NO: 36741 - RNA, 20 nt, Homo sapiens
gcauggccagucuacacuca

SEQ ID NO: 36742 - RNA, 17 nt, Homo sapiens
cccgccgcccgcugccc

SEQ ID NO: 36743 - RNA, 18 nt, Homo sapiens
aacuuagcuggguauggu

SEQ ID NO: 36744 - RNA, 24 nt, Homo sapiens
acaaucuuucuaauggcugggagc

SEQ ID NO: 36745 - RNA, 19 nt, Homo sapiens
acuuagcuggguauggugg

SEQ ID NO: 36746 - RNA, 22 nt, Homo sapiens
ccuacagauuggcccuuucucu

SEQ ID NO: 36747 - RNA, 17 nt, Homo sapiens
gcucuugcuauguggua

SEQ ID NO: 36748 - RNA, 23 nt, Homo sapiens
ugccuguaaucccagcacuuugg

SEQ ID NO: 36749 - RNA, 20 nt, Homo sapiens
ugggcuauacaaaaaagggg

SEQ ID NO: 36750 - RNA, 20 nt, Homo sapiens
aagcugcaagccccugggcc

SEQ ID NO: 36751 - RNA, 22 nt, Homo sapiens
aaguggguaagacggaagugga

SEQ ID NO: 36752 - RNA, 18 nt, Homo sapiens
cacagucugcccucucca

SEQ ID NO: 36753 - RNA, 16 nt, Homo sapiens
cccaaagucaggugca

SEQ ID NO: 36754 - RNA, 16 nt, Homo sapiens
guggccccaaagucag

SEQ ID NO: 36755 - RNA, 23 nt, Homo sapiens
uaaugcuguccuagcgugagugc

SEQ ID NO: 36756 - RNA, 17 nt, Homo sapiens
ugaaaugugcacagucu

SEQ ID NO: 36757 - RNA, 19 nt, Homo sapiens
ugccacagggcacguggcc

SEQ ID NO: 36758 - RNA, 19 nt, Homo sapiens
ugccagggagagacagaga

SEQ ID NO: 36759 - RNA, 17 nt, Homo sapiens
uggauguauggcaggau

SEQ ID NO: 36760 - RNA, 23 nt, Homo sapiens
aggaagacuaggauuauuuuuac

SEQ ID NO: 36761 - RNA, 19 nt, Homo sapiens
aggggcagggaaacugaau

SEQ ID NO: 36762 - RNA, 15 nt, Homo sapiens
ccugggaaggagaag

SEQ ID NO: 36763 - RNA, 18 nt, Homo sapiens
gacacacuugcccauguc

SEQ ID NO: 36764 - RNA, 19 nt, Homo sapiens
gcauucaaagagcacggca

SEQ ID NO: 36765 - RNA, 18 nt, Homo sapiens
ggaauauauaaaauauac

SEQ ID NO: 36766 - RNA, 17 nt, Homo sapiens
ggcaugcaguccucugg

SEQ ID NO: 36767 - RNA, 18 nt, Homo sapiens
gggaagagaggggagugg

SEQ ID NO: 36768 - RNA, 16 nt, Homo sapiens
ggggaagagaggggag

SEQ ID NO: 36769 - RNA, 19 nt, Homo sapiens
ggggaagagaggggagugg

SEQ ID NO: 36770 - RNA, 18 nt, Homo sapiens
gucuuagguuaauucgcu

SEQ ID NO: 36771 - RNA, 19 nt, Homo sapiens
uagaaucacaggacuggau

SEQ ID NO: 36772 - RNA, 21 nt, Homo sapiens
uagcuuucaauucaaauuagu

SEQ ID NO: 36773 - RNA, 18 nt, Homo sapiens
ucucuuaguggcaaguuc

SEQ ID NO: 36774 - RNA, 18 nt, Homo sapiens
uggaauauguuaccauuu

SEQ ID NO: 36775 - RNA, 18 nt, Homo sapiens
ugggaaggagaaggagaa

SEQ ID NO: 36776 - RNA, 21 nt, Homo sapiens
uggggaagagaggggaguggg

SEQ ID NO: 36777 - RNA, 20 nt, Homo sapiens
uuaaaguugggcccuaguca

SEQ ID NO: 36778 - RNA, 18 nt, Homo sapiens
uuauuugggacagaacag

SEQ ID NO: 36779 - RNA, 20 nt, Homo sapiens
uuucucaaaacauuaacuga

SEQ ID NO: 36780 - RNA, 19 nt, Homo sapiens
acuuacaacagaguuuaac

SEQ ID NO: 36781 - RNA, 17 nt, Homo sapiens
ggccaggaguucgagac

SEQ ID NO: 36782 - RNA, 19 nt, Homo sapiens
uaauaacauuuacauuucu

SEQ ID NO: 36783 - RNA, 18 nt, Homo sapiens
aaggaguuggaguggggu

SEQ ID NO: 36784 - RNA, 25 nt, Homo sapiens
agcgagaagcggggcgcagcagacg

SEQ ID NO: 36785 - RNA, 17 nt, Homo sapiens
aggcgaaggcgaaggcg

SEQ ID NO: 36786 - RNA, 19 nt, Homo sapiens
caggaucuagaucugagug

SEQ ID NO: 36787 - RNA, 23 nt, Homo sapiens
ccucccgcccgccaggcggcgcc

SEQ ID NO: 36788 - RNA, 24 nt, Homo sapiens
cgcggggaggagaaggaggggucc

SEQ ID NO: 36789 - RNA, 17 nt, Homo sapiens
cggaggaaacaaaaggc

SEQ ID NO: 36790 - RNA, 16 nt, Homo sapiens
cggcggcggcuggagc

SEQ ID NO: 36791 - RNA, 19 nt, Homo sapiens
cggggaggagaaggagggg

SEQ ID NO: 36792 - RNA, 19 nt, Homo sapiens
gcccccucccacuagcccg

SEQ ID NO: 36793 - RNA, 16 nt, Homo sapiens
gcccggccgcugcacc

SEQ ID NO: 36794 - RNA, 19 nt, Homo sapiens
gcgccacucucuccucucc

SEQ ID NO: 36795 - RNA, 15 nt, Homo sapiens
gcgccggcgcgcagc

SEQ ID NO: 36796 - RNA, 17 nt, Homo sapiens
gcgccggcgcgcagcca

SEQ ID NO: 36797 - RNA, 19 nt, Homo sapiens
gcgcgcgcgcgcgccgcgg

SEQ ID NO: 36798 - RNA, 21 nt, Homo sapiens
gcggcggggcgcgcacggggg

SEQ ID NO: 36799 - RNA, 21 nt, Homo sapiens
gcggggcgcgcacgggggcgg

SEQ ID NO: 36800 - RNA, 19 nt, Homo sapiens
ggaagggaggaugacgaac

SEQ ID NO: 36801 - RNA, 19 nt, Homo sapiens
ggaguggggaaaggggugg

SEQ ID NO: 36802 - RNA, 21 nt, Homo sapiens
ggcgguggcggcggcggcggc

SEQ ID NO: 36803 - RNA, 23 nt, Homo sapiens
gggcacgcgcacgcggggaggag

SEQ ID NO: 36804 - RNA, 20 nt, Homo sapiens
gggcgguggcgcgggccggg

SEQ ID NO: 36805 - RNA, 18 nt, Homo sapiens
ggggaggagaaggagggg

SEQ ID NO: 36806 - RNA, 18 nt, Homo sapiens
gguuccugagcagaccug

SEQ ID NO: 36807 - RNA, 20 nt, Homo sapiens
gucucgcaggugcgccgagu

SEQ ID NO: 36808 - RNA, 16 nt, Homo sapiens
ucgcuggacugcgcgc

SEQ ID NO: 36809 - RNA, 18 nt, Homo sapiens
ucgcuggcaucugagagg

SEQ ID NO: 36810 - RNA, 22 nt, Homo sapiens
ucuccgcccgcccgccuccccu

SEQ ID NO: 36811 - RNA, 21 nt, Homo sapiens
ugcccgcccccucccuucccc

SEQ ID NO: 36812 - RNA, 24 nt, Homo sapiens
ugccggcugucccaccuuccuggu

SEQ ID NO: 36813 - RNA, 23 nt, Homo sapiens
ugggagaaugggugguggagaag

SEQ ID NO: 36814 - RNA, 18 nt, Homo sapiens
uuggagugggguuggggg

SEQ ID NO: 36815 - RNA, 22 nt, Homo sapiens
agcugguggcuaguucccagga

SEQ ID NO: 36816 - RNA, 22 nt, Homo sapiens
cgaggagagacauguucugcug

SEQ ID NO: 36817 - RNA, 21 nt, Homo sapiens
gcggcggcggcagaguaggcc

SEQ ID NO: 36818 - RNA, 20 nt, Homo sapiens
guggcggcggcggcggcggc

SEQ ID NO: 36819 - RNA, 18 nt, Homo sapiens
agugggguggggaggagg

SEQ ID NO: 36820 - RNA, 17 nt, Homo sapiens
cccgccgcccgcugccc

SEQ ID NO: 36821 - RNA, 16 nt, Homo sapiens
cuuccugcuggggcuc

SEQ ID NO: 36822 - RNA, 16 nt, Homo sapiens
ggagugggguggggag

SEQ ID NO: 36823 - RNA, 23 nt, Homo sapiens
gucugggguucucuggcagcccc

SEQ ID NO: 36824 - RNA, 18 nt, Homo sapiens
ugaggaggagguggggga

SEQ ID NO: 36825 - RNA, 18 nt, Homo sapiens
aaagccauauaaauauua

SEQ ID NO: 36826 - RNA, 19 nt, Homo sapiens
aggggcuggcaccaaacca

SEQ ID NO: 36827 - RNA, 18 nt, Homo sapiens
agugggguggggaggagg

SEQ ID NO: 36828 - RNA, 22 nt, Homo sapiens
aguuauugguuuauggcuggaa

SEQ ID NO: 36829 - RNA, 17 nt, Homo sapiens
cccgccgcccgcugccc

SEQ ID NO: 36830 - RNA, 16 nt, Homo sapiens
cuuccugcuggggcuc

SEQ ID NO: 36831 - RNA, 16 nt, Homo sapiens
ggagugggguggggag

SEQ ID NO: 36832 - RNA, 23 nt, Homo sapiens
gucugggguucucuggcagcccc

SEQ ID NO: 36833 - RNA, 18 nt, Homo sapiens
ugaggaggagguggggga

SEQ ID NO: 36834 - RNA, 18 nt, Homo sapiens
aaagccauauaaauauua

SEQ ID NO: 36835 - RNA, 18 nt, Homo sapiens
agugggguggggaggagg

SEQ ID NO: 36836 - RNA, 22 nt, Homo sapiens
aguuauugguuuauggcuggaa

SEQ ID NO: 36837 - RNA, 16 nt, Homo sapiens
cuuccugcuggggcuc

SEQ ID NO: 36838 - RNA, 16 nt, Homo sapiens
ggagugggguggggag

SEQ ID NO: 36839 - RNA, 23 nt, Homo sapiens
gucugggguucucuggcagcccc

SEQ ID NO: 36840 - RNA, 18 nt, Homo sapiens
ugaggaggagguggggga

SEQ ID NO: 36841 - RNA, 18 nt, Homo sapiens
aaagccauauaaauauua

SEQ ID NO: 36842 - RNA, 19 nt, Homo sapiens
aggggcuggcaccaaacca

SEQ ID NO: 36843 - RNA, 18 nt, Homo sapiens
agugggguggggaggagg

SEQ ID NO: 36844 - RNA, 22 nt, Homo sapiens
aguuauugguuuauggcuggaa

SEQ ID NO: 36845 - RNA, 17 nt, Homo sapiens
cccgccgcccgcugccc

SEQ ID NO: 36846 - RNA, 16 nt, Homo sapiens
cuuccugcuggggcuc

SEQ ID NO: 36847 - RNA, 16 nt, Homo sapiens
ggagugggguggggag

SEQ ID NO: 36848 - RNA, 19 nt, Homo sapiens
uaaagugucaccacugaag

SEQ ID NO: 36849 - RNA, 18 nt, Homo sapiens
ugaggaggagguggggga

SEQ ID NO: 36850 - RNA, 18 nt, Homo sapiens
aaagccauauaaauauua

SEQ ID NO: 36851 - RNA, 19 nt, Homo sapiens
aggggcuggcaccaaacca

SEQ ID NO: 36852 - RNA, 18 nt, Homo sapiens
agugggguggggaggagg

SEQ ID NO: 36853 - RNA, 22 nt, Homo sapiens
aguuauugguuuauggcuggaa

SEQ ID NO: 36854 - RNA, 19 nt, Homo sapiens
cccauugugcucuaagcuu

SEQ ID NO: 36855 - RNA, 17 nt, Homo sapiens
cccgccgcccgcugccc

SEQ ID NO: 36856 - RNA, 16 nt, Homo sapiens
cuuccugcuggggcuc

SEQ ID NO: 36857 - RNA, 23 nt, Homo sapiens
gucugggguucucuggcagcccc

SEQ ID NO: 36858 - RNA, 18 nt, Homo sapiens
ugaggaggagguggggga

SEQ ID NO: 36859 - RNA, 18 nt, Homo sapiens
aaagccauauaaauauua

SEQ ID NO: 36860 - RNA, 19 nt, Homo sapiens
aggggcuggcaccaaacca

SEQ ID NO: 36861 - RNA, 18 nt, Homo sapiens
agugggguggggaggagg

SEQ ID NO: 36862 - RNA, 22 nt, Homo sapiens
aguuauugguuuauggcuggaa

SEQ ID NO: 36863 - RNA, 16 nt, Homo sapiens
cuuccugcuggggcuc

SEQ ID NO: 36864 - RNA, 16 nt, Homo sapiens
ggagugggguggggag

SEQ ID NO: 36865 - RNA, 23 nt, Homo sapiens
gucugggguucucuggcagcccc

SEQ ID NO: 36866 - RNA, 18 nt, Homo sapiens
ugaggaggagguggggga

SEQ ID NO: 36867 - RNA, 18 nt, Homo sapiens
aaagccauauaaauauua

SEQ ID NO: 36868 - RNA, 19 nt, Homo sapiens
aggggcuggcaccaaacca

SEQ ID NO: 36869 - RNA, 18 nt, Homo sapiens
agugggguggggaggagg

SEQ ID NO: 36870 - RNA, 22 nt, Homo sapiens
aguuauugguuuauggcuggaa

SEQ ID NO: 36871 - RNA, 17 nt, Homo sapiens
cccgccgcccgcugccc

SEQ ID NO: 36872 - RNA, 16 nt, Homo sapiens
cuuccugcuggggcuc

SEQ ID NO: 36873 - RNA, 16 nt, Homo sapiens
ggagugggguggggag

SEQ ID NO: 36874 - RNA, 23 nt, Homo sapiens
gucugggguucucuggcagcccc

SEQ ID NO: 36875 - RNA, 18 nt, Homo sapiens
ugaggaggagguggggga

SEQ ID NO: 36876 - RNA, 18 nt, Homo sapiens
aaagccauauaaauauua

SEQ ID NO: 36877 - RNA, 19 nt, Homo sapiens
aggggcuggcaccaaacca

SEQ ID NO: 36878 - RNA, 18 nt, Homo sapiens
agugggguggggaggagg

SEQ ID NO: 36879 - RNA, 22 nt, Homo sapiens
aguuauugguuuauggcuggaa

SEQ ID NO: 36880 - RNA, 17 nt, Homo sapiens
cccgccgcccgcugccc

SEQ ID NO: 36881 - RNA, 18 nt, Homo sapiens
cucgagcugguugguugu

SEQ ID NO: 36882 - RNA, 16 nt, Homo sapiens
cuuccugcuggggcuc

SEQ ID NO: 36883 - RNA, 17 nt, Homo sapiens
gccccuuugaaaucaaa

SEQ ID NO: 36884 - RNA, 16 nt, Homo sapiens
ggagugggguggggag

SEQ ID NO: 36885 - RNA, 23 nt, Homo sapiens
gucugggguucucuggcagcccc

SEQ ID NO: 36886 - RNA, 18 nt, Homo sapiens
aaagccauauaaauauua

SEQ ID NO: 36887 - RNA, 18 nt, Homo sapiens
agugggguggggaggagg

SEQ ID NO: 36888 - RNA, 22 nt, Homo sapiens
aguuauugguuuauggcuggaa

SEQ ID NO: 36889 - RNA, 17 nt, Homo sapiens
cccgccgcccgcugccc

SEQ ID NO: 36890 - RNA, 16 nt, Homo sapiens
ccuagcuaucugcuuu

SEQ ID NO: 36891 - RNA, 16 nt, Homo sapiens
cuuccugcuggggcuc

SEQ ID NO: 36892 - RNA, 16 nt, Homo sapiens
ggagugggguggggag

SEQ ID NO: 36893 - RNA, 23 nt, Homo sapiens
gucugggguucucuggcagcccc

SEQ ID NO: 36894 - RNA, 18 nt, Homo sapiens
aaagccauauaaauauua

SEQ ID NO: 36895 - RNA, 19 nt, Homo sapiens
aggggcuggcaccaaacca

SEQ ID NO: 36896 - RNA, 18 nt, Homo sapiens
agugggguggggaggagg

SEQ ID NO: 36897 - RNA, 22 nt, Homo sapiens
aguuauugguuuauggcuggaa

SEQ ID NO: 36898 - RNA, 17 nt, Homo sapiens
cccgccgcccgcugccc

SEQ ID NO: 36899 - RNA, 16 nt, Homo sapiens
cuuccugcuggggcuc

SEQ ID NO: 36900 - RNA, 16 nt, Homo sapiens
ggagugggguggggag

SEQ ID NO: 36901 - RNA, 23 nt, Homo sapiens
gucugggguucucuggcagcccc

SEQ ID NO: 36902 - RNA, 18 nt, Homo sapiens
ugaggaggagguggggga

SEQ ID NO: 36903 - RNA, 18 nt, Homo sapiens
aaagccauauaaauauua

SEQ ID NO: 36904 - RNA, 19 nt, Homo sapiens
aggggcuggcaccaaacca

SEQ ID NO: 36905 - RNA, 18 nt, Homo sapiens
agugggguggggaggagg

SEQ ID NO: 36906 - RNA, 22 nt, Homo sapiens
aguuauugguuuauggcuggaa

SEQ ID NO: 36907 - RNA, 17 nt, Homo sapiens
cccgccgcccgcugccc

SEQ ID NO: 36908 - RNA, 16 nt, Homo sapiens
cuuccugcuggggcuc

SEQ ID NO: 36909 - RNA, 16 nt, Homo sapiens
ggagugggguggggag

SEQ ID NO: 36910 - RNA, 23 nt, Homo sapiens
gucugggguucucuggcagcccc

SEQ ID NO: 36911 - RNA, 18 nt, Homo sapiens
ugaggaggagguggggga

SEQ ID NO: 36912 - RNA, 18 nt, Homo sapiens
aaagccauauaaauauua

SEQ ID NO: 36913 - RNA, 19 nt, Homo sapiens
aggggcuggcaccaaacca

SEQ ID NO: 36914 - RNA, 18 nt, Homo sapiens
agugggguggggaggagg

SEQ ID NO: 36915 - RNA, 22 nt, Homo sapiens
aguuauugguuuauggcuggaa

SEQ ID NO: 36916 - RNA, 17 nt, Homo sapiens
cccgccgcccgcugccc

SEQ ID NO: 36917 - RNA, 16 nt, Homo sapiens
cuuccugcuggggcuc

SEQ ID NO: 36918 - RNA, 16 nt, Homo sapiens
ggagugggguggggag

SEQ ID NO: 36919 - RNA, 23 nt, Homo sapiens
gucugggguucucuggcagcccc

SEQ ID NO: 36920 - RNA, 18 nt, Homo sapiens
ugaggaggagguggggga

SEQ ID NO: 36921 - RNA, 18 nt, Homo sapiens
aaagccauauaaauauua

SEQ ID NO: 36922 - RNA, 19 nt, Homo sapiens
aggggcuggcaccaaacca

SEQ ID NO: 36923 - RNA, 18 nt, Homo sapiens
agugggguggggaggagg

SEQ ID NO: 36924 - RNA, 22 nt, Homo sapiens
aguuauugguuuauggcuggaa

SEQ ID NO: 36925 - RNA, 17 nt, Homo sapiens
cccgccgcccgcugccc

SEQ ID NO: 36926 - RNA, 16 nt, Homo sapiens
cuuccugcuggggcuc

SEQ ID NO: 36927 - RNA, 16 nt, Homo sapiens
ggagugggguggggag

SEQ ID NO: 36928 - RNA, 23 nt, Homo sapiens
gucugggguucucuggcagcccc

SEQ ID NO: 36929 - RNA, 18 nt, Homo sapiens
ugaggaggagguggggga

SEQ ID NO: 36930 - RNA, 18 nt, Homo sapiens
aaagccauauaaauauua

SEQ ID NO: 36931 - RNA, 19 nt, Homo sapiens
aggggcuggcaccaaacca

SEQ ID NO: 36932 - RNA, 18 nt, Homo sapiens
agugggguggggaggagg

SEQ ID NO: 36933 - RNA, 22 nt, Homo sapiens
aguuauugguuuauggcuggaa

SEQ ID NO: 36934 - RNA, 17 nt, Homo sapiens
cccgccgcccgcugccc

SEQ ID NO: 36935 - RNA, 16 nt, Homo sapiens
cuuccugcuggggcuc

SEQ ID NO: 36936 - RNA, 16 nt, Homo sapiens
ggagugggguggggag

SEQ ID NO: 36937 - RNA, 18 nt, Homo sapiens
ugaggaggagguggggga

SEQ ID NO: 36938 - RNA, 18 nt, Homo sapiens
aaagccauauaaauauua

SEQ ID NO: 36939 - RNA, 18 nt, Homo sapiens
agugggguggggaggagg

SEQ ID NO: 36940 - RNA, 17 nt, Homo sapiens
cccgccgcccgcugccc

SEQ ID NO: 36941 - RNA, 16 nt, Homo sapiens
cuuccugcuggggcuc

SEQ ID NO: 36942 - RNA, 16 nt, Homo sapiens
ggagugggguggggag

SEQ ID NO: 36943 - RNA, 23 nt, Homo sapiens
gucugggguucucuggcagcccc

SEQ ID NO: 36944 - RNA, 18 nt, Homo sapiens
ugaggaggagguggggga

SEQ ID NO: 36945 - RNA, 18 nt, Homo sapiens
aaagccauauaaauauua

SEQ ID NO: 36946 - RNA, 18 nt, Homo sapiens
agugggguggggaggagg

SEQ ID NO: 36947 - RNA, 22 nt, Homo sapiens
aguuauugguuuauggcuggaa

SEQ ID NO: 36948 - RNA, 17 nt, Homo sapiens
cccgccgcccgcugccc

SEQ ID NO: 36949 - RNA, 16 nt, Homo sapiens
cuuccugcuggggcuc

SEQ ID NO: 36950 - RNA, 16 nt, Homo sapiens
ggagugggguggggag

SEQ ID NO: 36951 - RNA, 23 nt, Homo sapiens
gucugggguucucuggcagcccc

SEQ ID NO: 36952 - RNA, 18 nt, Homo sapiens
ugaggaggagguggggga

SEQ ID NO: 36953 - RNA, 21 nt, Homo sapiens
ccgggcggagaggcgggcggc

SEQ ID NO: 36954 - RNA, 17 nt, Homo sapiens
ggcccggaaacuggcgc

SEQ ID NO: 36955 - RNA, 18 nt, Homo sapiens
acuguuggggcucgaguu

SEQ ID NO: 36956 - RNA, 20 nt, Homo sapiens
cgaggaaaauuuucuugcug

SEQ ID NO: 36957 - RNA, 24 nt, Homo sapiens
gcugcuggcccuccccagcuucug

SEQ ID NO: 36958 - RNA, 14 nt, Homo sapiens
gugugaaccuuggu

SEQ ID NO: 36959 - RNA, 15 nt, Homo sapiens
uggaaggcaaggacu

SEQ ID NO: 36960 - RNA, 19 nt, Homo sapiens
uuucucuuggcaccccaau

SEQ ID NO: 36961 - RNA, 20 nt, Homo sapiens
agaagucuuacauguuugga

SEQ ID NO: 36962 - RNA, 16 nt, Homo sapiens
agauugggauggggcu

SEQ ID NO: 36963 - RNA, 21 nt, Homo sapiens
agcauccugaugucaccuuaa

SEQ ID NO: 36964 - RNA, 17 nt, Homo sapiens
agugagggucuugacgu

SEQ ID NO: 36965 - RNA, 20 nt, Homo sapiens
aguugugaaggaaugguauu

SEQ ID NO: 36966 - RNA, 20 nt, Homo sapiens
auaccauugagugagggggu

SEQ ID NO: 36967 - RNA, 21 nt, Homo sapiens
auggcuacucauggucuccuu

SEQ ID NO: 36968 - RNA, 15 nt, Homo sapiens
cacacuuucguggga

SEQ ID NO: 36969 - RNA, 19 nt, Homo sapiens
cagcagcuucagaccagcc

SEQ ID NO: 36970 - RNA, 20 nt, Homo sapiens
ccugcuguuucucuuggcac

SEQ ID NO: 36971 - RNA, 19 nt, Homo sapiens
cugaagagggugauagaaa

SEQ ID NO: 36972 - RNA, 25 nt, Homo sapiens
cugccgccucucucaaccacaggcg

SEQ ID NO: 36973 - RNA, 18 nt, Homo sapiens
cugcuggcugcuggccaa

SEQ ID NO: 36974 - RNA, 20 nt, Homo sapiens
gagcccauuuuaugagauug

SEQ ID NO: 36975 - RNA, 18 nt, Homo sapiens
gauuacuggguguugaua

SEQ ID NO: 36976 - RNA, 21 nt, Homo sapiens
gcugccuggggugcucaugag

SEQ ID NO: 36977 - RNA, 24 nt, Homo sapiens
ggcugaauguccuuucugcuucuu

SEQ ID NO: 36978 - RNA, 18 nt, Homo sapiens
ggugcucaugagucucca

SEQ ID NO: 36979 - RNA, 19 nt, Homo sapiens
uagggggcggugguggugg

SEQ ID NO: 36980 - RNA, 21 nt, Homo sapiens
ucgaacuccugaccucgugau

SEQ ID NO: 36981 - RNA, 19 nt, Homo sapiens
ucugcuucuugaaggucug

SEQ ID NO: 36982 - RNA, 21 nt, Homo sapiens
ugccagccagugguaggcaca

SEQ ID NO: 36983 - RNA, 17 nt, Homo sapiens
ugcggucagugcuggca

SEQ ID NO: 36984 - RNA, 18 nt, Homo sapiens
uuccaggugaaagcaggu

SEQ ID NO: 36985 - RNA, 21 nt, Homo sapiens
uugcugaugacucugaugagg

SEQ ID NO: 36986 - RNA, 19 nt, Homo sapiens
uugguagucuccucuucag

SEQ ID NO: 36987 - RNA, 18 nt, Homo sapiens
uuguguggacucuggguu

SEQ ID NO: 36988 - RNA, 19 nt, Homo sapiens
agggaggccaggguggcgg

SEQ ID NO: 36989 - RNA, 22 nt, Homo sapiens
aggggcggccgggagacggggg

SEQ ID NO: 36990 - RNA, 16 nt, Homo sapiens
ccagcagguggccgag

SEQ ID NO: 36991 - RNA, 19 nt, Homo sapiens
cccugguacguaaaauggc

SEQ ID NO: 36992 - RNA, 20 nt, Homo sapiens
ccucgcgggcuggggcuugg

SEQ ID NO: 36993 - RNA, 17 nt, Homo sapiens
gaggggaggcggcgggc

SEQ ID NO: 36994 - RNA, 16 nt, Homo sapiens
gcggccgggagacggg

SEQ ID NO: 36995 - RNA, 17 nt, Homo sapiens
gcggcgggcgagggggg

SEQ ID NO: 36996 - RNA, 19 nt, Homo sapiens
ggaggcggcgggcgagggg

SEQ ID NO: 36997 - RNA, 18 nt, Homo sapiens
ggccucgcgggcuggggc

SEQ ID NO: 36998 - RNA, 18 nt, Homo sapiens
ggggaccgcgggcgaucg

SEQ ID NO: 36999 - RNA, 20 nt, Homo sapiens
ggggaggcggcgggcgaggg

SEQ ID NO: 37000 - RNA, 18 nt, Homo sapiens
ggggcggagcgggccggg

SEQ ID NO: 37001 - RNA, 18 nt, Homo sapiens
uauaagcuauacgauaua

SEQ ID NO: 37002 - RNA, 22 nt, Homo sapiens
ucccuaacauugugcugucccu

SEQ ID NO: 37003 - RNA, 20 nt, Homo sapiens
ucccugguacguaaaauggc

SEQ ID NO: 37004 - RNA, 15 nt, Homo sapiens
ucgcgucgaaggugu

SEQ ID NO: 37005 - RNA, 24 nt, Homo sapiens
ugaccaguauguaacaagaaugcu

SEQ ID NO: 37006 - RNA, 21 nt, Homo sapiens
ugggaagggaagaggggcggc

SEQ ID NO: 37007 - RNA, 18 nt, Homo sapiens
uggggaaagaggggaccg

SEQ ID NO: 37008 - RNA, 28 nt, Homo sapiens
ugugcgcgcgcguguguagcccccgcgg

SEQ ID NO: 37009 - RNA, 22 nt, Homo sapiens
uucccuucuacacucucacaca

SEQ ID NO: 37010 - RNA, 16 nt, Homo sapiens
cauccuauuaacugau

SEQ ID NO: 37011 - RNA, 17 nt, Homo sapiens
gcccgcgcugcugauuc

SEQ ID NO: 37012 - RNA, 16 nt, Homo sapiens
uggaauaugaacaucc

SEQ ID NO: 37013 - RNA, 14 nt, Homo sapiens
gggucccacgccgc

SEQ ID NO: 37014 - RNA, 21 nt, Homo sapiens
gcagugagcugagaucgugcc

SEQ ID NO: 37015 - RNA, 19 nt, Homo sapiens
gcccuggucccaccuucuc

SEQ ID NO: 37016 - RNA, 17 nt, Homo sapiens
ucaagggcuggauuugg

SEQ ID NO: 37017 - RNA, 17 nt, Homo sapiens
ucucguugacucuaggg

SEQ ID NO: 37018 - RNA, 17 nt, Homo sapiens
uugggaggccaaggugg

SEQ ID NO: 37019 - RNA, 19 nt, Homo sapiens
acaaaaauuucucaacaau

SEQ ID NO: 37020 - RNA, 17 nt, Homo sapiens
cagcagucgccacuucc

SEQ ID NO: 37021 - RNA, 18 nt, Homo sapiens
ccaguggccaguuguguc

SEQ ID NO: 37022 - RNA, 19 nt, Homo sapiens
ccgcccacggaggcccacu

SEQ ID NO: 37023 - RNA, 21 nt, Homo sapiens
cggccgggcucguggcgccgc

SEQ ID NO: 37024 - RNA, 16 nt, Homo sapiens
gugacgagcgugcggc

SEQ ID NO: 37025 - RNA, 23 nt, Homo sapiens
uaaauuggaaaccaauguucugu

SEQ ID NO: 37026 - RNA, 20 nt, Homo sapiens
uaagaacaacacaguuugga

SEQ ID NO: 37027 - RNA, 24 nt, Homo sapiens
ucuuugguguguugaacaggacga

SEQ ID NO: 37028 - RNA, 23 nt, Homo sapiens
ugacauucguaaguggagacugu

SEQ ID NO: 37029 - RNA, 19 nt, Homo sapiens
ugcagcuggcauacucaua

SEQ ID NO: 37030 - RNA, 19 nt, Homo sapiens
uuccaguugguaugguacc

SEQ ID NO: 37031 - RNA, 19 nt, Homo sapiens
aagcuuaaguuauaucuuu

SEQ ID NO: 37032 - RNA, 17 nt, Homo sapiens
agccaccaugccuggcc

SEQ ID NO: 37033 - RNA, 16 nt, Homo sapiens
ucauugguaacgccaa

SEQ ID NO: 37034 - RNA, 21 nt, Homo sapiens
uccaaacuguuacugucucgg

SEQ ID NO: 37035 - RNA, 22 nt, Homo sapiens
ucuuuuaucuaguucucugaau

SEQ ID NO: 37036 - RNA, 18 nt, Homo sapiens
uucguccaauaaauaaag

SEQ ID NO: 37037 - RNA, 19 nt, Homo sapiens
uugaaccuuugacccucua

SEQ ID NO: 37038 - RNA, 18 nt, Homo sapiens
cccaccuuccuccauaca

SEQ ID NO: 37039 - RNA, 24 nt, Homo sapiens
gcccacccgcucgccugccacacc

SEQ ID NO: 37040 - RNA, 22 nt, Homo sapiens
uucagguauuuggggacuacau

SEQ ID NO: 37041 - RNA, 18 nt, Homo sapiens
uaugugugugugugugug

SEQ ID NO: 37042 - RNA, 23 nt, Homo sapiens
ugauugaggucauaaauuaagaa

SEQ ID NO: 37043 - RNA, 18 nt, Homo sapiens
ugugugugugugugugug

SEQ ID NO: 37044 - RNA, 20 nt, Homo sapiens
ugugugugugugugugugua

SEQ ID NO: 37045 - RNA, 28 nt, Homo sapiens
uuuguaucauauaugugugugugugugu

SEQ ID NO: 37046 - RNA, 18 nt, Homo sapiens
aaagccauauaaauauua

SEQ ID NO: 37047 - RNA, 18 nt, Homo sapiens
agugggguggggaggagg

SEQ ID NO: 37048 - RNA, 22 nt, Homo sapiens
aguuauugguuuauggcuggaa

SEQ ID NO: 37049 - RNA, 17 nt, Homo sapiens
cccgccgcccgcugccc

SEQ ID NO: 37050 - RNA, 16 nt, Homo sapiens
ggagugggguggggag

SEQ ID NO: 37051 - RNA, 23 nt, Homo sapiens
gucugggguucucuggcagcccc

SEQ ID NO: 37052 - RNA, 18 nt, Homo sapiens
ugaggaggagguggggga

SEQ ID NO: 37053 - RNA, 18 nt, Homo sapiens
uuucagcggguuagcgcu

SEQ ID NO: 37054 - RNA, 19 nt, Homo sapiens
aggggcuggcaccaaacca

SEQ ID NO: 37055 - RNA, 18 nt, Homo sapiens
agugggguggggaggagg

SEQ ID NO: 37056 - RNA, 16 nt, Homo sapiens
cuuccugcuggggcuc

SEQ ID NO: 37057 - RNA, 18 nt, Homo sapiens
ggguuagcgcuugggcgc

SEQ ID NO: 37058 - RNA, 21 nt, Homo sapiens
acaaaaagcagcuugaagguu

SEQ ID NO: 37059 - RNA, 25 nt, Homo sapiens
caauggcagcagugacaggaucugu

SEQ ID NO: 37060 - RNA, 19 nt, Homo sapiens
ccuccccgucuuugcaauc

SEQ ID NO: 37061 - RNA, 17 nt, Homo sapiens
ccuuucccccuccccuc

SEQ ID NO: 37062 - RNA, 16 nt, Homo sapiens
cugcuucuuuuguucu

SEQ ID NO: 37063 - RNA, 20 nt, Homo sapiens
ggaaacauauuauuuggaau

SEQ ID NO: 37064 - RNA, 18 nt, Homo sapiens
uacgucaagcaccaaaug

SEQ ID NO: 37065 - RNA, 18 nt, Homo sapiens
uuacaaauuuaacuaucc

SEQ ID NO: 37066 - RNA, 22 nt, Homo sapiens
ugcuacaaagaaaucaugaaaa

SEQ ID NO: 37067 - RNA, 18 nt, Homo sapiens
aaagccauauaaauauua

SEQ ID NO: 37068 - RNA, 19 nt, Homo sapiens
aggggcuggcaccaaacca

SEQ ID NO: 37069 - RNA, 18 nt, Homo sapiens
agugggguggggaggagg

SEQ ID NO: 37070 - RNA, 17 nt, Homo sapiens
cccgccgcccgcugccc

SEQ ID NO: 37071 - RNA, 16 nt, Homo sapiens
cuuccugcuggggcuc

SEQ ID NO: 37072 - RNA, 16 nt, Homo sapiens
ggagugggguggggag

SEQ ID NO: 37073 - RNA, 23 nt, Homo sapiens
gucugggguucucuggcagcccc

SEQ ID NO: 37074 - RNA, 18 nt, Homo sapiens
ugaggaggagguggggga

SEQ ID NO: 37075 - RNA, 19 nt, Homo sapiens
aggggcuggcaccaaacca

SEQ ID NO: 37076 - RNA, 18 nt, Homo sapiens
agugggguggggaggagg

SEQ ID NO: 37077 - RNA, 22 nt, Homo sapiens
aguuauugguuuauggcuggaa

SEQ ID NO: 37078 - RNA, 17 nt, Homo sapiens
cccgccgcccgcugccc

SEQ ID NO: 37079 - RNA, 16 nt, Homo sapiens
cuuccugcuggggcuc

SEQ ID NO: 37080 - RNA, 16 nt, Homo sapiens
ggagugggguggggag

SEQ ID NO: 37081 - RNA, 23 nt, Homo sapiens
gucugggguucucuggcagcccc

SEQ ID NO: 37082 - RNA, 18 nt, Homo sapiens
ugaggaggagguggggga

SEQ ID NO: 37083 - RNA, 21 nt, Homo sapiens
acggaggaagcagaggccaca

SEQ ID NO: 37084 - RNA, 19 nt, Homo sapiens
agaaggggagauucaggaa

SEQ ID NO: 37085 - RNA, 21 nt, Homo sapiens
ccugcuuuucuucugcucccc

SEQ ID NO: 37086 - RNA, 19 nt, Homo sapiens
cuggcggcugcuggggccg

SEQ ID NO: 37087 - RNA, 17 nt, Homo sapiens
gcggaacgccacggcgc

SEQ ID NO: 37088 - RNA, 21 nt, Homo sapiens
gcggcggcggugggacuggcg

SEQ ID NO: 37089 - RNA, 17 nt, Homo sapiens
ggacuggcggcugcugg

SEQ ID NO: 37090 - RNA, 24 nt, Homo sapiens
ggcggcggcggugggacuggcggc

SEQ ID NO: 37091 - RNA, 19 nt, Homo sapiens
ggcggcugcuggggccggc

SEQ ID NO: 37092 - RNA, 16 nt, Homo sapiens
gggggggugggaggag

SEQ ID NO: 37093 - RNA, 18 nt, Homo sapiens
ggggugggggaagggagg

SEQ ID NO: 37094 - RNA, 19 nt, Homo sapiens
gggguggggugggggaagg

SEQ ID NO: 37095 - RNA, 22 nt, Homo sapiens
uaugaugcuggugaauacacaa

SEQ ID NO: 37096 - RNA, 20 nt, Homo sapiens
ucgucguccuugggcaggag

SEQ ID NO: 37097 - RNA, 19 nt, Homo sapiens
ugguaugugggugggcugg

SEQ ID NO: 37098 - RNA, 22 nt, Homo sapiens
uuuuugggggggugggaggagc

SEQ ID NO: 37099 - RNA, 19 nt, Homo sapiens
agucaccaaccugcucuca

SEQ ID NO: 37100 - RNA, 18 nt, Homo sapiens
gggcucccuacaccugcc

SEQ ID NO: 37101 - RNA, 19 nt, Homo sapiens
gggcucccuacaccugccu

SEQ ID NO: 37102 - RNA, 15 nt, Homo sapiens
ggggaggggaggggg

SEQ ID NO: 37103 - RNA, 17 nt, Homo sapiens
ggggaggggagggggaa

SEQ ID NO: 37104 - RNA, 22 nt, Homo sapiens
uaaggaaacacccuaauugccu

SEQ ID NO: 37105 - RNA, 19 nt, Homo sapiens
caggcacgccagaggccga

SEQ ID NO: 37106 - RNA, 18 nt, Homo sapiens
aacuguacugggaagggu

SEQ ID NO: 37107 - RNA, 23 nt, Homo sapiens
acucacaguucacgggacacugc

SEQ ID NO: 37108 - RNA, 21 nt, Homo sapiens
agagggaggggagggaggggg

SEQ ID NO: 37109 - RNA, 24 nt, Homo sapiens
ccaggcucugcuccggcuccggcc

SEQ ID NO: 37110 - RNA, 21 nt, Homo sapiens
cccagagucauccccucagcg

SEQ ID NO: 37111 - RNA, 17 nt, Homo sapiens
ccccgaguccucucccc

SEQ ID NO: 37112 - RNA, 20 nt, Homo sapiens
ccccuuauucuccuuuucau

SEQ ID NO: 37113 - RNA, 20 nt, Homo sapiens
cgccccccuccuccggggcc

SEQ ID NO: 37114 - RNA, 18 nt, Homo sapiens
cggcgccccccuccuccg

SEQ ID NO: 37115 - RNA, 19 nt, Homo sapiens
cggcgcgccaaagagaagc

SEQ ID NO: 37116 - RNA, 24 nt, Homo sapiens
gagagggaggggagggagggggca

SEQ ID NO: 37117 - RNA, 19 nt, Homo sapiens
gcgggcggagaauccccgg

SEQ ID NO: 37118 - RNA, 24 nt, Homo sapiens
ggagacuacucgcgucacagagcg

SEQ ID NO: 37119 - RNA, 17 nt, Homo sapiens
gggagggcagcgauaga

SEQ ID NO: 37120 - RNA, 19 nt, Homo sapiens
uaauuugcaaaauacagug

SEQ ID NO: 37121 - RNA, 19 nt, Homo sapiens
ugcauagacaccaguagua

SEQ ID NO: 37122 - RNA, 22 nt, Homo sapiens
uggccgggaaugggggugggag

SEQ ID NO: 37123 - RNA, 20 nt, Homo sapiens
uguaaagaacuuugcuguug

SEQ ID NO: 37124 - RNA, 24 nt, Homo sapiens
cacaacacuguuuaaucagcucug

SEQ ID NO: 37125 - RNA, 18 nt, Homo sapiens
ccucaacacggccgcccc

SEQ ID NO: 37126 - RNA, 18 nt, Homo sapiens
ccucaccacggccgcccc

SEQ ID NO: 37127 - RNA, 17 nt, Homo sapiens
gggaccuacucugcccu

SEQ ID NO: 37128 - RNA, 23 nt, Homo sapiens
gugccugccccacaaagccuggg

SEQ ID NO: 37129 - RNA, 19 nt, Homo sapiens
uagcaagugacauuuccac

SEQ ID NO: 37130 - RNA, 20 nt, Homo sapiens
ucagggccauggaggggacc

SEQ ID NO: 37131 - RNA, 21 nt, Homo sapiens
uggcgggcgggcagggcgggc

SEQ ID NO: 37132 - RNA, 19 nt, Homo sapiens
aagcaggaaggggaaggag

SEQ ID NO: 37133 - RNA, 18 nt, Homo sapiens
caauuauuucugagccca

SEQ ID NO: 37134 - RNA, 17 nt, Homo sapiens
cgaaauucuauccucac

SEQ ID NO: 37135 - RNA, 17 nt, Homo sapiens
cuaguaagagcacugag

SEQ ID NO: 37136 - RNA, 17 nt, Homo sapiens
gagaggagggaaggugg

SEQ ID NO: 37137 - RNA, 17 nt, Homo sapiens
gcugucucacaaaaaga

SEQ ID NO: 37138 - RNA, 21 nt, Homo sapiens
gggcugggagggcuggagagg

SEQ ID NO: 37139 - RNA, 20 nt, Homo sapiens
gggcuggugagggcuggugg

SEQ ID NO: 37140 - RNA, 18 nt, Homo sapiens
uccgcgggggcuggugag

SEQ ID NO: 37141 - RNA, 21 nt, Homo sapiens
ugaggugccaacaaagcauuu

SEQ ID NO: 37142 - RNA, 22 nt, Homo sapiens
ugaggugccaacaaaggcauuu

SEQ ID NO: 37143 - RNA, 16 nt, Homo sapiens
ugauuuuaauccuaaa

SEQ ID NO: 37144 - RNA, 18 nt, Homo sapiens
uguaacaaacugcaaucu

SEQ ID NO: 37145 - RNA, 19 nt, Homo sapiens
ggguacacacgcgacgcgg

SEQ ID NO: 37146 - RNA, 21 nt, Homo sapiens
uguagaaauuuuugauaagaa

SEQ ID NO: 37147 - RNA, 16 nt, Homo sapiens
accccuccccuccccc

SEQ ID NO: 37148 - RNA, 16 nt, Homo sapiens
cacaggcucuggcccc

SEQ ID NO: 37149 - RNA, 17 nt, Homo sapiens
cagacaaugaagucgcu

SEQ ID NO: 37150 - RNA, 16 nt, Homo sapiens
ccacaccccggugucc

SEQ ID NO: 37151 - RNA, 20 nt, Homo sapiens
ccacugcuguugguuucugu

SEQ ID NO: 37152 - RNA, 18 nt, Homo sapiens
cccucccgccuggccugg

SEQ ID NO: 37153 - RNA, 19 nt, Homo sapiens
ccugacucauccacggcag

SEQ ID NO: 37154 - RNA, 23 nt, Homo sapiens
cgcuggcagagaaggcuuccucc

SEQ ID NO: 37155 - RNA, 21 nt, Homo sapiens
cuguggccucgugacuccugc

SEQ ID NO: 37156 - RNA, 17 nt, Homo sapiens
gaggagcaguggcagug

SEQ ID NO: 37157 - RNA, 18 nt, Homo sapiens
gcgagagaggugggcagc

SEQ ID NO: 37158 - RNA, 19 nt, Homo sapiens
gcugguguguccucuucug

SEQ ID NO: 37159 - RNA, 16 nt, Homo sapiens
ggaggagaaggggagg

SEQ ID NO: 37160 - RNA, 18 nt, Homo sapiens
ucugagagaagcugaggg

SEQ ID NO: 37161 - RNA, 20 nt, Homo sapiens
uguccccgcucauuuuguuu

SEQ ID NO: 37162 - RNA, 19 nt, Homo sapiens
cccaagcucugcggcccgg

SEQ ID NO: 37163 - RNA, 18 nt, Homo sapiens
cccggagcugcgacucgg

SEQ ID NO: 37164 - RNA, 18 nt, Homo sapiens
gccugccugccggugccc

SEQ ID NO: 37165 - RNA, 19 nt, Homo sapiens
gguuuucugcuucucccag

SEQ ID NO: 37166 - RNA, 15 nt, Homo sapiens
uucugcuucucccag

SEQ ID NO: 37167 - RNA, 17 nt, Homo sapiens
cgcagacgugggugaca

SEQ ID NO: 37168 - RNA, 16 nt, Homo sapiens
gaaggaagacaagaag

SEQ ID NO: 37169 - RNA, 18 nt, Homo sapiens
gccgagggcgguggcggc

SEQ ID NO: 37170 - RNA, 17 nt, Homo sapiens
gcgacgguggggacugc

SEQ ID NO: 37171 - RNA, 17 nt, Homo sapiens
gcggcagcgacgguggg

SEQ ID NO: 37172 - RNA, 17 nt, Homo sapiens
gcgguggcggcggcagc

SEQ ID NO: 37173 - RNA, 21 nt, Homo sapiens
gugggugacacguggccccgc

SEQ ID NO: 37174 - RNA, 20 nt, Homo sapiens
ucaccaaaccccaccucccc

SEQ ID NO: 37175 - RNA, 18 nt, Homo sapiens
ucuugaagaccagccucu

SEQ ID NO: 37176 - RNA, 18 nt, Homo sapiens
ugggaaggcgccacaggc

SEQ ID NO: 37177 - RNA, 16 nt, Homo sapiens
ggugcgucgugcucuu

SEQ ID NO: 37178 - RNA, 23 nt, Homo sapiens
uagcauauuaagcucauuguauu

SEQ ID NO: 37179 - RNA, 22 nt, Homo sapiens
acaaaucacaauguaauuccca

SEQ ID NO: 37180 - RNA, 21 nt, Homo sapiens
agcuccgggccaggugugccg

SEQ ID NO: 37181 - RNA, 24 nt, Homo sapiens
gggcgccggcucggcggggaggag

SEQ ID NO: 37182 - RNA, 21 nt, Homo sapiens
ucugcauauuuugggggcauu

SEQ ID NO: 37183 - RNA, 17 nt, Homo sapiens
ugcccucgcccaauuug

SEQ ID NO: 37184 - RNA, 19 nt, Homo sapiens
uuucucaaccuaguuagcc

SEQ ID NO: 37185 - RNA, 18 nt, Homo sapiens
acacagagugagacucug

SEQ ID NO: 37186 - RNA, 15 nt, Homo sapiens
acgguggcucacgcc

SEQ ID NO: 37187 - RNA, 19 nt, Homo sapiens
agaaggaugcaguucaugu

SEQ ID NO: 37188 - RNA, 18 nt, Homo sapiens
cauugauugacugagccc

SEQ ID NO: 37189 - RNA, 22 nt, Homo sapiens
cguggugguggggcgcccgcag

SEQ ID NO: 37190 - RNA, 24 nt, Homo sapiens
uagaaacuguauuccgugaaagga

SEQ ID NO: 37191 - RNA, 23 nt, Homo sapiens
uccccagguaacugaggggcggg

SEQ ID NO: 37192 - RNA, 22 nt, Homo sapiens
ugcacauucuguccccugccau

SEQ ID NO: 37193 - RNA, 17 nt, Homo sapiens
uggccuggaauguuucc

SEQ ID NO: 37194 - RNA, 24 nt, Homo sapiens
caaggcauauacaaaagucugaca

SEQ ID NO: 37195 - RNA, 15 nt, Homo sapiens
uggcuuucgccucuc

SEQ ID NO: 37196 - RNA, 20 nt, Homo sapiens
agugucugcuggacgcagcg

SEQ ID NO: 37197 - RNA, 18 nt, Homo sapiens
cccuagucccugcucucu

SEQ ID NO: 37198 - RNA, 16 nt, Homo sapiens
cccugcucucugagca

SEQ ID NO: 37199 - RNA, 20 nt, Homo sapiens
ccuccccacccucuccaguc

SEQ ID NO: 37200 - RNA, 20 nt, Homo sapiens
cuccugcucaggaaaggaag

SEQ ID NO: 37201 - RNA, 19 nt, Homo sapiens
ucaguuaccaccccguaug

SEQ ID NO: 37202 - RNA, 18 nt, Homo sapiens
ugagugcgguugcugaca

SEQ ID NO: 37203 - RNA, 19 nt, Homo sapiens
ugccauuaggggccagugg

SEQ ID NO: 37204 - RNA, 15 nt, Homo sapiens
ccgccgcugccgccc

SEQ ID NO: 37205 - RNA, 19 nt, Homo sapiens
gcccuggguccaaccccuc

SEQ ID NO: 37206 - RNA, 18 nt, Homo sapiens
gcgggagggagggggggg

SEQ ID NO: 37207 - RNA, 21 nt, Homo sapiens
ucucccgcaccgcucccgccg

SEQ ID NO: 37208 - RNA, 19 nt, Homo sapiens
ccauccccacugcgcgcgc

SEQ ID NO: 37209 - RNA, 16 nt, Homo sapiens
cugcucgggcccccag

SEQ ID NO: 37210 - RNA, 19 nt, Homo sapiens
acuaggcuacauugggggc

SEQ ID NO: 37211 - RNA, 18 nt, Homo sapiens
agagggagagaaaaagcc

SEQ ID NO: 37212 - RNA, 19 nt, Homo sapiens
cucugguccugcaguuccu

SEQ ID NO: 37213 - RNA, 19 nt, Homo sapiens
uuauauaauauagaccuuu

SEQ ID NO: 37214 - RNA, 18 nt, Homo sapiens
cagcugccccccgaaacg

SEQ ID NO: 37215 - RNA, 17 nt, Homo sapiens
gcaggccccaaggccuu

SEQ ID NO: 37216 - RNA, 16 nt, Homo sapiens
ggagaaagagcaggag

SEQ ID NO: 37217 - RNA, 21 nt, Homo sapiens
ggugggagccggaauggggcc

SEQ ID NO: 37218 - RNA, 20 nt, Homo sapiens
gcgauccagacgcugauacc

SEQ ID NO: 37219 - RNA, 18 nt, Homo sapiens
gucgggggauggcgggcg

SEQ ID NO: 37220 - RNA, 16 nt, Homo sapiens
ugcagucguacagcag

SEQ ID NO: 37221 - RNA, 20 nt, Homo sapiens
agcucucuggggccuuuuua

SEQ ID NO: 37222 - RNA, 18 nt, Homo sapiens
ccacguccucauauggug

SEQ ID NO: 37223 - RNA, 22 nt, Homo sapiens
ccuggcuucuauuuacuggaug

SEQ ID NO: 37224 - RNA, 28 nt, Homo sapiens
gagacugcuguauucaauaccaacgugg

SEQ ID NO: 37225 - RNA, 18 nt, Homo sapiens
ucuaaucacuucccaaag

SEQ ID NO: 37226 - RNA, 19 nt, Homo sapiens
ugcauuauaggauguuuag

SEQ ID NO: 37227 - RNA, 17 nt, Homo sapiens
uuccugaucuagacagc

SEQ ID NO: 37228 - RNA, 16 nt, Homo sapiens
agcaagcauaaauaac

SEQ ID NO: 37229 - RNA, 16 nt, Homo sapiens
cccacuccccuccccc

SEQ ID NO: 37230 - RNA, 21 nt, Homo sapiens
cccgguucccacuccccuccc

SEQ ID NO: 37231 - RNA, 18 nt, Homo sapiens
cccucccuccccuuuccc

SEQ ID NO: 37232 - RNA, 15 nt, Homo sapiens
ccuuggugaugaggc

SEQ ID NO: 37233 - RNA, 20 nt, Homo sapiens
gaagcugguuugacauuuug

SEQ ID NO: 37234 - RNA, 17 nt, Homo sapiens
gcuggacggaaauguau

SEQ ID NO: 37235 - RNA, 21 nt, Homo sapiens
gcuuugucccggugugccacc

SEQ ID NO: 37236 - RNA, 20 nt, Homo sapiens
ggagaucaaaugauugggau

SEQ ID NO: 37237 - RNA, 23 nt, Homo sapiens
ggcagucagcuguugaggugcag

SEQ ID NO: 37238 - RNA, 18 nt, Homo sapiens
gggugcugguguuuaaaa

SEQ ID NO: 37239 - RNA, 20 nt, Homo sapiens
gggugggaguacuuggggag

SEQ ID NO: 37240 - RNA, 21 nt, Homo sapiens
ggugcugguguuuaaaaggag

SEQ ID NO: 37241 - RNA, 22 nt, Homo sapiens
gugaagacugggagggaacccu

SEQ ID NO: 37242 - RNA, 18 nt, Homo sapiens
uaaggcugagacuaggga

SEQ ID NO: 37243 - RNA, 16 nt, Homo sapiens
uagggcaugacuagau

SEQ ID NO: 37244 - RNA, 22 nt, Homo sapiens
uccccuuuccccagcauauugc

SEQ ID NO: 37245 - RNA, 16 nt, Homo sapiens
ucccucgguuuccauu

SEQ ID NO: 37246 - RNA, 22 nt, Homo sapiens
ucccucgguuuccauuuggucc

SEQ ID NO: 37247 - RNA, 17 nt, Homo sapiens
ugccucugggcuuggcu

SEQ ID NO: 37248 - RNA, 21 nt, Homo sapiens
ugucccggugugccaccucug

SEQ ID NO: 37249 - RNA, 18 nt, Homo sapiens
cucaacauuccaagggaa

SEQ ID NO: 37250 - RNA, 21 nt, Homo sapiens
gcaaaacuuggccaauacaca

SEQ ID NO: 37251 - RNA, 15 nt, Homo sapiens
guaaucccagccacu

SEQ ID NO: 37252 - RNA, 21 nt, Homo sapiens
uaccgucuugaaauuuaaguu

SEQ ID NO: 37253 - RNA, 18 nt, Homo sapiens
ugggggacgggagggagc

SEQ ID NO: 37254 - RNA, 22 nt, Homo sapiens
ugugucuaguauagccccuucc

SEQ ID NO: 37255 - RNA, 18 nt, Homo sapiens
aaaaaaaaaaaauagcau

SEQ ID NO: 37256 - RNA, 21 nt, Homo sapiens
aaaaacccaagacacuggaag

SEQ ID NO: 37257 - RNA, 20 nt, Homo sapiens
aagaggaacagugggaucca

SEQ ID NO: 37258 - RNA, 22 nt, Homo sapiens
aauacucuuaauuauugauauu

SEQ ID NO: 37259 - RNA, 17 nt, Homo sapiens
cacauggugcugucgug

SEQ ID NO: 37260 - RNA, 21 nt, Homo sapiens
cagcagcuccuugcuuuacag

SEQ ID NO: 37261 - RNA, 20 nt, Homo sapiens
cagggagcacugagccacug

SEQ ID NO: 37262 - RNA, 19 nt, Homo sapiens
ccgaugaaguaaggcugcu

SEQ ID NO: 37263 - RNA, 20 nt, Homo sapiens
gacaagcaggguuccucagg

SEQ ID NO: 37264 - RNA, 21 nt, Homo sapiens
gcaacuauggucugaugugua

SEQ ID NO: 37265 - RNA, 18 nt, Homo sapiens
ggguuuuuuugaagcuuu

SEQ ID NO: 37266 - RNA, 15 nt, Homo sapiens
ucugugcgcucucag

SEQ ID NO: 37267 - RNA, 18 nt, Homo sapiens
ucuguggcaaagaggaac

SEQ ID NO: 37268 - RNA, 18 nt, Homo sapiens
ugccaaauuacggugugu

SEQ ID NO: 37269 - RNA, 18 nt, Homo sapiens
uggcaucuguguauguac

SEQ ID NO: 37270 - RNA, 19 nt, Homo sapiens
uauagaugacauuccacua

SEQ ID NO: 37271 - RNA, 18 nt, Homo sapiens
uucugaucccuuugcaac

SEQ ID NO: 37272 - RNA, 21 nt, Homo sapiens
uugcaugggcuguuuuucuua

SEQ ID NO: 37273 - RNA, 23 nt, Homo sapiens
uuuguguuuguucucacucuugc

SEQ ID NO: 37274 - RNA, 18 nt, Homo sapiens
gaccggccucgcccugca

SEQ ID NO: 37275 - RNA, 18 nt, Homo sapiens
ucuccgguguuugacugu

SEQ ID NO: 37276 - RNA, 21 nt, Homo sapiens
cccucugggguggcgggcggc

SEQ ID NO: 37277 - RNA, 20 nt, Homo sapiens
ucuagauauuucuguguauu

SEQ ID NO: 37278 - RNA, 20 nt, Homo sapiens
ugaaaugggccucgucccag

SEQ ID NO: 37279 - RNA, 20 nt, Homo sapiens
accccagcccuccggggccu

SEQ ID NO: 37280 - RNA, 20 nt, Homo sapiens
cagcugcaaggccgcgcggc

SEQ ID NO: 37281 - RNA, 20 nt, Homo sapiens
caugccaccuccuuugcccc

SEQ ID NO: 37282 - RNA, 16 nt, Homo sapiens
cucggcaacacggaag

SEQ ID NO: 37283 - RNA, 18 nt, Homo sapiens
gcccggguagggccggcc

SEQ ID NO: 37284 - RNA, 20 nt, Homo sapiens
ucugagcuggagcugcuggc

SEQ ID NO: 37285 - RNA, 21 nt, Homo sapiens
ccgcaaccgccuggucccugc

SEQ ID NO: 37286 - RNA, 17 nt, Homo sapiens
caagugugaaaccugga

SEQ ID NO: 37287 - RNA, 16 nt, Homo sapiens
gcugagugagcagcag

SEQ ID NO: 37288 - RNA, 23 nt, Homo sapiens
ucugcucaggaacagaggucugu

SEQ ID NO: 37289 - RNA, 20 nt, Homo sapiens
ucuucuugaccuccaggagg

SEQ ID NO: 37290 - RNA, 19 nt, Homo sapiens
accuaguaaaauuauuuuc

SEQ ID NO: 37291 - RNA, 22 nt, Homo sapiens
acugauuuuugucacuauuggu

SEQ ID NO: 37292 - RNA, 20 nt, Homo sapiens
agagagaaaaugugaaaaua

SEQ ID NO: 37293 - RNA, 16 nt, Homo sapiens
agguaaacgaaaggga

SEQ ID NO: 37294 - RNA, 15 nt, Homo sapiens
aucacaauagccacu

SEQ ID NO: 37295 - RNA, 22 nt, Homo sapiens
auugcaauuuuuugguuaacua

SEQ ID NO: 37296 - RNA, 23 nt, Homo sapiens
cacgugugugugugugugugugu

SEQ ID NO: 37297 - RNA, 20 nt, Homo sapiens
cauuacaaaaucuaugucua

SEQ ID NO: 37298 - RNA, 21 nt, Homo sapiens
cauuuaaaugugugugugugu

SEQ ID NO: 37299 - RNA, 18 nt, Homo sapiens
ccaagauaguuaaagaga

SEQ ID NO: 37300 - RNA, 21 nt, Homo sapiens
ccuuuucuuuuuaaauacaca

SEQ ID NO: 37301 - RNA, 22 nt, Homo sapiens
cgcaguccgcagagcagccgga

SEQ ID NO: 37302 - RNA, 19 nt, Homo sapiens
cugugucaaccuauaccac

SEQ ID NO: 37303 - RNA, 18 nt, Homo sapiens
gaggcuauucaggcagcc

SEQ ID NO: 37304 - RNA, 19 nt, Homo sapiens
gcaguuguaggacuacaua

SEQ ID NO: 37305 - RNA, 18 nt, Homo sapiens
uaaacacaaucuaagucu

SEQ ID NO: 37306 - RNA, 18 nt, Homo sapiens
uaacauagauaguaacca

SEQ ID NO: 37307 - RNA, 20 nt, Homo sapiens
uaagugacucgugcuuugga

SEQ ID NO: 37308 - RNA, 21 nt, Homo sapiens
uacaucuguagaauaugauug

SEQ ID NO: 37309 - RNA, 16 nt, Homo sapiens
uagaucaucagaaaac

SEQ ID NO: 37310 - RNA, 22 nt, Homo sapiens
uaugaggauuuaagaaccuccc

SEQ ID NO: 37311 - RNA, 20 nt, Homo sapiens
uauucugcauccaauuuucc

SEQ ID NO: 37312 - RNA, 19 nt, Homo sapiens
ugagauuuugaugguuuuu

SEQ ID NO: 37313 - RNA, 23 nt, Homo sapiens
ugcugaauuucugugaacagcca

SEQ ID NO: 37314 - RNA, 18 nt, Homo sapiens
ugcuguagcgggcucuac

SEQ ID NO: 37315 - RNA, 19 nt, Homo sapiens
ugugcacgugugugugugu

SEQ ID NO: 37316 - RNA, 19 nt, Homo sapiens
ugugugugcacgugugugu

SEQ ID NO: 37317 - RNA, 19 nt, Homo sapiens
uguguguguguagaucauc

SEQ ID NO: 37318 - RNA, 18 nt, Homo sapiens
ugugugugugugugugug

SEQ ID NO: 37319 - RNA, 20 nt, Homo sapiens
uuauuuuuacugaacacccu

SEQ ID NO: 37320 - RNA, 16 nt, Homo sapiens
uuccagauaugaggau

SEQ ID NO: 37321 - RNA, 20 nt, Homo sapiens
uugcagagagaaaaugugaa

SEQ ID NO: 37322 - RNA, 19 nt, Homo sapiens
uugucacuauugguucuuu

SEQ ID NO: 37323 - RNA, 23 nt, Homo sapiens
caagaagagggugcccagucauu

SEQ ID NO: 37324 - RNA, 18 nt, Homo sapiens
cggcuccucccgccccga

SEQ ID NO: 37325 - RNA, 22 nt, Homo sapiens
cuuuccauuugcuacauacugg

SEQ ID NO: 37326 - RNA, 21 nt, Homo sapiens
uaacuuuuuaauaauuaaaag

SEQ ID NO: 37327 - RNA, 18 nt, Homo sapiens
ugugugugugugugugug

SEQ ID NO: 37328 - RNA, 15 nt, Homo sapiens
aucacaauagccacu

SEQ ID NO: 37329 - RNA, 20 nt, Homo sapiens
ucuggauaaaaggaggcaag

SEQ ID NO: 37330 - RNA, 19 nt, Homo sapiens
accuaguaaaauuauuuuc

SEQ ID NO: 37331 - RNA, 22 nt, Homo sapiens
acugauuuuugucacuauuggu

SEQ ID NO: 37332 - RNA, 20 nt, Homo sapiens
agagagaaaaugugaaaaua

SEQ ID NO: 37333 - RNA, 16 nt, Homo sapiens
agguaaacgaaaggga

SEQ ID NO: 37334 - RNA, 22 nt, Homo sapiens
auugcaauuuuuugguuaacua

SEQ ID NO: 37335 - RNA, 23 nt, Homo sapiens
caagaagagggugcccagucauu

SEQ ID NO: 37336 - RNA, 23 nt, Homo sapiens
cacgugugugugugugugugugu

SEQ ID NO: 37337 - RNA, 20 nt, Homo sapiens
cauuacaaaaucuaugucua

SEQ ID NO: 37338 - RNA, 18 nt, Homo sapiens
ccaagauaguuaaagaga

SEQ ID NO: 37339 - RNA, 21 nt, Homo sapiens
ccuuuucuuuuuaaauacaca

SEQ ID NO: 37340 - RNA, 22 nt, Homo sapiens
cgcaguccgcagagcagccgga

SEQ ID NO: 37341 - RNA, 19 nt, Homo sapiens
cugugucaaccuauaccac

SEQ ID NO: 37342 - RNA, 22 nt, Homo sapiens
cuuuccauuugcuacauacugg

SEQ ID NO: 37343 - RNA, 18 nt, Homo sapiens
gaggcuauucaggcagcc

SEQ ID NO: 37344 - RNA, 19 nt, Homo sapiens
gcaguugugggacuacaua

SEQ ID NO: 37345 - RNA, 18 nt, Homo sapiens
uaaacacaaucuaagucu

SEQ ID NO: 37346 - RNA, 18 nt, Homo sapiens
uaacauagauaguaacca

SEQ ID NO: 37347 - RNA, 18 nt, Homo sapiens
uaacauggguuuaaaaug

SEQ ID NO: 37348 - RNA, 21 nt, Homo sapiens
uaacuuuuuaauaauuaaaag

SEQ ID NO: 37349 - RNA, 20 nt, Homo sapiens
uaagugacucgugcuuugga

SEQ ID NO: 37350 - RNA, 16 nt, Homo sapiens
uagaucaucagaaaac

SEQ ID NO: 37351 - RNA, 18 nt, Homo sapiens
uaguacgcucugucauga

SEQ ID NO: 37352 - RNA, 22 nt, Homo sapiens
uaugaggauuuaagaaccuccc

SEQ ID NO: 37353 - RNA, 19 nt, Homo sapiens
ugagauuuugaugguuuuu

SEQ ID NO: 37354 - RNA, 18 nt, Homo sapiens
ugcuguagcgggcucuac

SEQ ID NO: 37355 - RNA, 19 nt, Homo sapiens
ugugcacgugugugugugu

SEQ ID NO: 37356 - RNA, 17 nt, Homo sapiens
uguguguaugugugugu

SEQ ID NO: 37357 - RNA, 19 nt, Homo sapiens
ugugugugcacgugugugu

SEQ ID NO: 37358 - RNA, 21 nt, Homo sapiens
uguguguguaugugugugugu

SEQ ID NO: 37359 - RNA, 19 nt, Homo sapiens
uguguguguguagaucauc

SEQ ID NO: 37360 - RNA, 19 nt, Homo sapiens
uguguguguguaugugugu

SEQ ID NO: 37361 - RNA, 19 nt, Homo sapiens
uguguguguguguguaugu

SEQ ID NO: 37362 - RNA, 18 nt, Homo sapiens
ugugugugugugugugug

SEQ ID NO: 37363 - RNA, 18 nt, Homo sapiens
uuacaucucacugcagau

SEQ ID NO: 37364 - RNA, 20 nt, Homo sapiens
uuauuuuuacugaacacccu

SEQ ID NO: 37365 - RNA, 16 nt, Homo sapiens
uuccagauaugaggau

SEQ ID NO: 37366 - RNA, 20 nt, Homo sapiens
uugcagagagaaaaugugaa

SEQ ID NO: 37367 - RNA, 19 nt, Homo sapiens
uugucacuauugguucuuu

SEQ ID NO: 37368 - RNA, 21 nt, Homo sapiens
agaccagcuuaggcaacauag

SEQ ID NO: 37369 - RNA, 20 nt, Homo sapiens
uucaugccuguagucccaga

SEQ ID NO: 37370 - RNA, 18 nt, Homo sapiens
caucaccaguuuucaugu

SEQ ID NO: 37371 - RNA, 17 nt, Homo sapiens
gaggaagggggacugaa

SEQ ID NO: 37372 - RNA, 15 nt, Homo sapiens
ggaaaaagcugagag

SEQ ID NO: 37373 - RNA, 20 nt, Homo sapiens
gggggucugucaggagcugc

SEQ ID NO: 37374 - RNA, 19 nt, Homo sapiens
uaugacuuuuuucucuuuc

SEQ ID NO: 37375 - RNA, 17 nt, Homo sapiens
ucaucaucugucugaca

SEQ ID NO: 37376 - RNA, 18 nt, Homo sapiens
uguguauaacagcagcau

SEQ ID NO: 37377 - RNA, 22 nt, Homo sapiens
uuccaauaaaugacaauucguu

SEQ ID NO: 37378 - RNA, 15 nt, Homo sapiens
uuggacagguugugg

SEQ ID NO: 37379 - RNA, 19 nt, Homo sapiens
aacaaauuuacuguacaug

SEQ ID NO: 37380 - RNA, 15 nt, Homo sapiens
aauuggguguucugu

SEQ ID NO: 37381 - RNA, 17 nt, Homo sapiens
agaggcaaucuaagcuc

SEQ ID NO: 37382 - RNA, 16 nt, Homo sapiens
cagcuuaggcaacaua

SEQ ID NO: 37383 - RNA, 18 nt, Homo sapiens
gaaccuuaaaaugcaccu

SEQ ID NO: 37384 - RNA, 20 nt, Homo sapiens
gaagagacuucaagacuugc

SEQ ID NO: 37385 - RNA, 19 nt, Homo sapiens
gaaguuuggggggacaagu

SEQ ID NO: 37386 - RNA, 20 nt, Homo sapiens
gcuggccuguagauugaguc

SEQ ID NO: 37387 - RNA, 18 nt, Homo sapiens
ggccuguagauugagucc

SEQ ID NO: 37388 - RNA, 20 nt, Homo sapiens
gggaggacagcuugagccug

SEQ ID NO: 37389 - RNA, 20 nt, Homo sapiens
gggaggaucgcuugagccca

SEQ ID NO: 37390 - RNA, 17 nt, Homo sapiens
gguggguggacugugac

SEQ ID NO: 37391 - RNA, 21 nt, Homo sapiens
uccaguaaaugaggacuguga

SEQ ID NO: 37392 - RNA, 23 nt, Homo sapiens
ucgaacuccugaccucaagugau

SEQ ID NO: 37393 - RNA, 21 nt, Homo sapiens
ugcagggcugugaagugagac

SEQ ID NO: 37394 - RNA, 21 nt, Homo sapiens
uguaguucuauuucuaaauaa

SEQ ID NO: 37395 - RNA, 17 nt, Homo sapiens
uguauaugcacugugaa

SEQ ID NO: 37396 - RNA, 21 nt, Homo sapiens
augacaauucguucccuuuuc

SEQ ID NO: 37397 - RNA, 20 nt, Homo sapiens
caguuucucuugcauuuccu

SEQ ID NO: 37398 - RNA, 19 nt, Homo sapiens
ccucuuggagcuggagcag

SEQ ID NO: 37399 - RNA, 21 nt, Homo sapiens
gcagugagcugagaucgugcc

SEQ ID NO: 37400 - RNA, 21 nt, Homo sapiens
gcgugaacccgggaguuggag

SEQ ID NO: 37401 - RNA, 23 nt, Homo sapiens
ucuaggacaaaaagggcggagga

SEQ ID NO: 37402 - RNA, 20 nt, Homo sapiens
ucucuugcauuuccugugca

SEQ ID NO: 37403 - RNA, 19 nt, Homo sapiens
ugagaucgugccacugccc

SEQ ID NO: 37404 - RNA, 18 nt, Homo sapiens
uucacuugucaggcucuu

SEQ ID NO: 37405 - RNA, 19 nt, Homo sapiens
uugaagagggugacuagag

SEQ ID NO: 37406 - RNA, 17 nt, Homo sapiens
uugggaggcugaggugg

SEQ ID NO: 37407 - RNA, 20 nt, Homo sapiens
guggaucaugaggucaggag

SEQ ID NO: 37408 - RNA, 19 nt, Homo sapiens
gcaaugccaaugucgauga

SEQ ID NO: 37409 - RNA, 19 nt, Homo sapiens
gcacgcgggggcgcggccu

SEQ ID NO: 37410 - RNA, 19 nt, Homo sapiens
ggccaggcggcacggcgcg

SEQ ID NO: 37411 - RNA, 22 nt, Homo sapiens
ugaaaggcuuccaccugggagg

SEQ ID NO: 37412 - RNA, 21 nt, Homo sapiens
uuuuuaauccccagcucauau

SEQ ID NO: 37413 - RNA, 17 nt, Homo sapiens
acaaaacuagaauacac

SEQ ID NO: 37414 - RNA, 21 nt, Homo sapiens
agccacagguaugagcugcga

SEQ ID NO: 37415 - RNA, 24 nt, Homo sapiens
caugucucugcucaggcucaaacc

SEQ ID NO: 37416 - RNA, 19 nt, Homo sapiens
cucaaguuacaggcagcuc

SEQ ID NO: 37417 - RNA, 22 nt, Homo sapiens
uacacagucuuaagugggggga

SEQ ID NO: 37418 - RNA, 20 nt, Homo sapiens
ugacagccagugagacuugg

SEQ ID NO: 37419 - RNA, 19 nt, Homo sapiens
uuuauauaauagcucuuca

SEQ ID NO: 37420 - RNA, 18 nt, Homo sapiens
caggcucccgggcccggc

SEQ ID NO: 37421 - RNA, 17 nt, Homo sapiens
ggcccggccccgcccuc

SEQ ID NO: 37422 - RNA, 14 nt, Homo sapiens
aaagaccagaaacu

SEQ ID NO: 37423 - RNA, 19 nt, Homo sapiens
caugaugcugacauuuuag

SEQ ID NO: 37424 - RNA, 15 nt, Homo sapiens
aaacugaaguucugc

SEQ ID NO: 37425 - RNA, 18 nt, Homo sapiens
agggaaauaaaggggaag

SEQ ID NO: 37426 - RNA, 17 nt, Homo sapiens
cccagccccauucuccc

SEQ ID NO: 37427 - RNA, 15 nt, Homo sapiens
cuuugcccaagccag

SEQ ID NO: 37428 - RNA, 16 nt, Homo sapiens
gcaggggugugauugg

SEQ ID NO: 37429 - RNA, 16 nt, Homo sapiens
gucucuucucucggcu

SEQ ID NO: 37430 - RNA, 15 nt, Homo sapiens
ugcuguagacuuugc

SEQ ID NO: 37431 - RNA, 20 nt, Homo sapiens
uggaaaagggaaauaaaggg

SEQ ID NO: 37432 - RNA, 21 nt, Homo sapiens
aacagguccgaaaagcucuuc

SEQ ID NO: 37433 - RNA, 21 nt, Homo sapiens
aggggcccgugcgugucgguc

SEQ ID NO: 37434 - RNA, 17 nt, Homo sapiens
cgccgcauggccgcccc

SEQ ID NO: 37435 - RNA, 19 nt, Homo sapiens
cgcgggcugcggccgccgc

SEQ ID NO: 37436 - RNA, 21 nt, Homo sapiens
cggccgcggcuggagagcgcg

SEQ ID NO: 37437 - RNA, 14 nt, Homo sapiens
cucugcucucccag

SEQ ID NO: 37438 - RNA, 21 nt, Homo sapiens
gccgcgcgcgggcugcggccg

SEQ ID NO: 37439 - RNA, 19 nt, Homo sapiens
gccgcggcuggagagcgcg

SEQ ID NO: 37440 - RNA, 21 nt, Homo sapiens
gcgugucggucgcgcuccugu

SEQ ID NO: 37441 - RNA, 18 nt, Homo sapiens
gcuaccaugucauauaau

SEQ ID NO: 37442 - RNA, 16 nt, Homo sapiens
ggcaggcgggcggccg

SEQ ID NO: 37443 - RNA, 18 nt, Homo sapiens
ugaggggagcuggcgagc

SEQ ID NO: 37444 - RNA, 19 nt, Homo sapiens
cggagcagccucggcugag

SEQ ID NO: 37445 - RNA, 20 nt, Homo sapiens
gcgggggggcgaccgguggc

SEQ ID NO: 37446 - RNA, 16 nt, Homo sapiens
ccaaagcugcucacgg

SEQ ID NO: 37447 - RNA, 19 nt, Homo sapiens
ccuggagaggcuagugugc

SEQ ID NO: 37448 - RNA, 18 nt, Homo sapiens
gagagccagggagugggg

SEQ ID NO: 37449 - RNA, 21 nt, Homo sapiens
ggguggggucgguggccccgg

SEQ ID NO: 37450 - RNA, 19 nt, Homo sapiens
ugagagccagggagugggg

SEQ ID NO: 37451 - RNA, 17 nt, Homo sapiens
aagagcauggauacuga

SEQ ID NO: 37452 - RNA, 18 nt, Homo sapiens
acgcguguucucuacaag

SEQ ID NO: 37453 - RNA, 20 nt, Homo sapiens
ccccagggaauuuacaaagu

SEQ ID NO: 37454 - RNA, 22 nt, Homo sapiens
uacaguauaagauaacauuuac

SEQ ID NO: 37455 - RNA, 18 nt, Homo sapiens
aacucucuuuuucccguu

SEQ ID NO: 37456 - RNA, 19 nt, Homo sapiens
acuucucuaucagaaauuc

SEQ ID NO: 37457 - RNA, 21 nt, Homo sapiens
acuuuguuucgaacguagaca

SEQ ID NO: 37458 - RNA, 18 nt, Homo sapiens
gaguuuaaaacuuuuuuu

SEQ ID NO: 37459 - RNA, 20 nt, Homo sapiens
uuguuagaauaauaauugug

SEQ ID NO: 37460 - RNA, 14 nt, Homo sapiens
aagcagggaagaug

SEQ ID NO: 37461 - RNA, 20 nt, Homo sapiens
agccggccaugagcuuggcc

SEQ ID NO: 37462 - RNA, 19 nt, Homo sapiens
aggaggaggaggcggcggc

SEQ ID NO: 37463 - RNA, 22 nt, Homo sapiens
aggaugcggcgccaagccggag

SEQ ID NO: 37464 - RNA, 20 nt, Homo sapiens
agggguguggcaucccucca

SEQ ID NO: 37465 - RNA, 19 nt, Homo sapiens
caaacgggacuuuugcaag

SEQ ID NO: 37466 - RNA, 15 nt, Homo sapiens
ccagaggaggaugcg

SEQ ID NO: 37467 - RNA, 22 nt, Homo sapiens
cccccggacucguuggcgccgg

SEQ ID NO: 37468 - RNA, 20 nt, Homo sapiens
ccccugcaacuggggauggc

SEQ ID NO: 37469 - RNA, 16 nt, Homo sapiens
ccucagagccgcgggg

SEQ ID NO: 37470 - RNA, 22 nt, Homo sapiens
cgggacugcaggagagaaagag

SEQ ID NO: 37471 - RNA, 18 nt, Homo sapiens
cuuaggguggaggaaggg

SEQ ID NO: 37472 - RNA, 17 nt, Homo sapiens
gagcggucugaucgcgg

SEQ ID NO: 37473 - RNA, 17 nt, Homo sapiens
gcaaacgggacuuuugc

SEQ ID NO: 37474 - RNA, 22 nt, Homo sapiens
gcggcggcgguggcugaggcgg

SEQ ID NO: 37475 - RNA, 24 nt, Homo sapiens
ggccaauggguggguugacaggcc

SEQ ID NO: 37476 - RNA, 16 nt, Homo sapiens
ggccggcgcggcggcg

SEQ ID NO: 37477 - RNA, 21 nt, Homo sapiens
ggcggcggcggcggcgguggc

SEQ ID NO: 37478 - RNA, 22 nt, Homo sapiens
ggcggcucgcggcacagagcgg

SEQ ID NO: 37479 - RNA, 24 nt, Homo sapiens
uccgcagcgggaggggacgcggcc

SEQ ID NO: 37480 - RNA, 20 nt, Homo sapiens
ucuccuccuguucgccgcag

SEQ ID NO: 37481 - RNA, 18 nt, Homo sapiens
ugaggaggaggaggcggc

SEQ ID NO: 37482 - RNA, 20 nt, Homo sapiens
ugaggaggaggaggcggcgg

SEQ ID NO: 37483 - RNA, 16 nt, Homo sapiens
aagggggaagauggaa

SEQ ID NO: 37484 - RNA, 17 nt, Homo sapiens
cccccucccccuagucc

SEQ ID NO: 37485 - RNA, 18 nt, Homo sapiens
ccggccggggacgccccc

SEQ ID NO: 37486 - RNA, 21 nt, Homo sapiens
cgcgacccgcgucccggccgg

SEQ ID NO: 37487 - RNA, 15 nt, Homo sapiens
cggcggcggcggcgg

SEQ ID NO: 37488 - RNA, 21 nt, Homo sapiens
cgucccggccggggacgcccc

SEQ ID NO: 37489 - RNA, 21 nt, Homo sapiens
gcgcucggcccggcagccguc

SEQ ID NO: 37490 - RNA, 22 nt, Homo sapiens
gcggcggcggcgggagacugcc

SEQ ID NO: 37491 - RNA, 23 nt, Homo sapiens
ggcagcggcggcggcggcgggag

SEQ ID NO: 37492 - RNA, 22 nt, Homo sapiens
uaggacuacaaggcaaaagggg

SEQ ID NO: 37493 - RNA, 20 nt, Homo sapiens
ucgguccagccgccccucgc

SEQ ID NO: 37494 - RNA, 18 nt, Homo sapiens
ugaaaaccaggagugugc

SEQ ID NO: 37495 - RNA, 20 nt, Homo sapiens
agcugcaauacucagcaggc

SEQ ID NO: 37496 - RNA, 16 nt, Homo sapiens
ggagagaaaaguccuu

SEQ ID NO: 37497 - RNA, 16 nt, Homo sapiens
gggucauucauucuau

SEQ ID NO: 37498 - RNA, 22 nt, Homo sapiens
ucaagaacaaaauacagggagg

SEQ ID NO: 37499 - RNA, 22 nt, Homo sapiens
agggaggagcggggaacacaag

SEQ ID NO: 37500 - RNA, 18 nt, Homo sapiens
cguggacacccaauucca

SEQ ID NO: 37501 - RNA, 18 nt, Homo sapiens
ucaaagcugguuagugca

SEQ ID NO: 37502 - RNA, 22 nt, Homo sapiens
ugcuauagacagcgccguaucc

SEQ ID NO: 37503 - RNA, 20 nt, Homo sapiens
uuccaggaaggguuuaggga

SEQ ID NO: 37504 - RNA, 18 nt, Homo sapiens
cacugauugagaaagccu

SEQ ID NO: 37505 - RNA, 19 nt, Homo sapiens
gaaagcacaaugagaaaua

SEQ ID NO: 37506 - RNA, 21 nt, Homo sapiens
gcuacuuuguaguuuuuaaaa

SEQ ID NO: 37507 - RNA, 25 nt, Homo sapiens
uaaaaacgagaaaaaaaacugcauu

SEQ ID NO: 37508 - RNA, 20 nt, Homo sapiens
uauagcaccugagauuuauu

SEQ ID NO: 37509 - RNA, 22 nt, Homo sapiens
ucauucacauguuccaccucuu

SEQ ID NO: 37510 - RNA, 19 nt, Homo sapiens
ucuuaucagaaaacagaug

SEQ ID NO: 37511 - RNA, 23 nt, Homo sapiens
uuacugcauccacaugauagaca

SEQ ID NO: 37512 - RNA, 19 nt, Homo sapiens
cuugaacuccugaccuugu

SEQ ID NO: 37513 - RNA, 19 nt, Homo sapiens
gaacuccugaccuugugau

SEQ ID NO: 37514 - RNA, 20 nt, Homo sapiens
ucuauuuuuguauguuucaa

SEQ ID NO: 37515 - RNA, 15 nt, Homo sapiens
uggaaaaugagaggc

SEQ ID NO: 37516 - RNA, 19 nt, Homo sapiens
aaccgggagcggcuucaac

SEQ ID NO: 37517 - RNA, 22 nt, Homo sapiens
acgaggcugcccuggggaucug

SEQ ID NO: 37518 - RNA, 19 nt, Homo sapiens
cccgagccucccagccugg

SEQ ID NO: 37519 - RNA, 22 nt, Homo sapiens
cccugucuggggaggugcuagc

SEQ ID NO: 37520 - RNA, 19 nt, Homo sapiens
cccuuggcuucuccccucc

SEQ ID NO: 37521 - RNA, 18 nt, Homo sapiens
cuguguggcugcguccag

SEQ ID NO: 37522 - RNA, 20 nt, Homo sapiens
gagcuggggagggaaccggg

SEQ ID NO: 37523 - RNA, 17 nt, Homo sapiens
gagggaaccgggagcgg

SEQ ID NO: 37524 - RNA, 19 nt, Homo sapiens
gcccugaggcaagcucggg

SEQ ID NO: 37525 - RNA, 19 nt, Homo sapiens
gcugcccuggggaucuggc

SEQ ID NO: 37526 - RNA, 18 nt, Homo sapiens
ggaguggggagguggcgg

SEQ ID NO: 37527 - RNA, 17 nt, Homo sapiens
ggccgacaggcuggagc

SEQ ID NO: 37528 - RNA, 19 nt, Homo sapiens
gggccagauggugugggcu

SEQ ID NO: 37529 - RNA, 16 nt, Homo sapiens
ggggccccgagugguu

SEQ ID NO: 37530 - RNA, 18 nt, Homo sapiens
uggcuucuccccuccccc

SEQ ID NO: 37531 - RNA, 18 nt, Homo sapiens
uuccuaauucuccugggc

SEQ ID NO: 37532 - RNA, 19 nt, Homo sapiens
acccagagccacagccccc

SEQ ID NO: 37533 - RNA, 20 nt, Homo sapiens
agaagccccacccacaggaa

SEQ ID NO: 37534 - RNA, 20 nt, Homo sapiens
agcagccuaccccagagccg

SEQ ID NO: 37535 - RNA, 21 nt, Homo sapiens
agcgugagcgccggggggggc

SEQ ID NO: 37536 - RNA, 17 nt, Homo sapiens
aggaguacugccccguu

SEQ ID NO: 37537 - RNA, 18 nt, Homo sapiens
cagcagcucugggcagcc

SEQ ID NO: 37538 - RNA, 23 nt, Homo sapiens
cccaucucagggcugugggaccu

SEQ ID NO: 37539 - RNA, 21 nt, Homo sapiens
ccccagggagaagccaacgca

SEQ ID NO: 37540 - RNA, 23 nt, Homo sapiens
cccgcaccuugagggugggagcc

SEQ ID NO: 37541 - RNA, 23 nt, Homo sapiens
cccguccagggggagccgcggcc

SEQ ID NO: 37542 - RNA, 14 nt, Homo sapiens
cggcgcgccuggag

SEQ ID NO: 37543 - RNA, 21 nt, Homo sapiens
gaaggggccuugcccugguca

SEQ ID NO: 37544 - RNA, 15 nt, Homo sapiens
gaggcgcuccgcccu

SEQ ID NO: 37545 - RNA, 14 nt, Homo sapiens
gccggggggggccg

SEQ ID NO: 37546 - RNA, 20 nt, Homo sapiens
ggagacacuagcuccaggga

SEQ ID NO: 37547 - RNA, 22 nt, Homo sapiens
ggagcccgggcagggcgggccu

SEQ ID NO: 37548 - RNA, 15 nt, Homo sapiens
gggcuguggacaggc

SEQ ID NO: 37549 - RNA, 18 nt, Homo sapiens
gggcuguggacaggcgga

SEQ ID NO: 37550 - RNA, 21 nt, Homo sapiens
guccagggggagccgcggccg

SEQ ID NO: 37551 - RNA, 18 nt, Homo sapiens
ucuuugggagggccucgg

SEQ ID NO: 37552 - RNA, 18 nt, Homo sapiens
ugaggggccaggaagggg

SEQ ID NO: 37553 - RNA, 21 nt, Homo sapiens
uggcacaggcgucggcgcgcc

SEQ ID NO: 37554 - RNA, 16 nt, Homo sapiens
aguuauggugugaagg

SEQ ID NO: 37555 - RNA, 18 nt, Homo sapiens
ccuggaaguagggcucgg

SEQ ID NO: 37556 - RNA, 14 nt, Homo sapiens
cggggccgcccgcc

SEQ ID NO: 37557 - RNA, 19 nt, Homo sapiens
gcacguuucccucuccccu

SEQ ID NO: 37558 - RNA, 18 nt, Homo sapiens
gcuuggcccagccucguc

SEQ ID NO: 37559 - RNA, 20 nt, Homo sapiens
ggcaccagcgcuccggggcc

SEQ ID NO: 37560 - RNA, 19 nt, Homo sapiens
ggcacguuucccucucccc

SEQ ID NO: 37561 - RNA, 20 nt, Homo sapiens
uaaaaaaaaaaaaaaaaaaa

SEQ ID NO: 37562 - RNA, 19 nt, Homo sapiens
uaggggcauaagugguggu

SEQ ID NO: 37563 - RNA, 16 nt, Homo sapiens
uggcacaacccgagcc

SEQ ID NO: 37564 - RNA, 22 nt, Homo sapiens
uucuaggggcauaagugguggu

SEQ ID NO: 37565 - RNA, 23 nt, Homo sapiens
aacugggcauuuagaagcaaguu

SEQ ID NO: 37566 - RNA, 21 nt, Homo sapiens
cagccaguuucccuuucuuuc

SEQ ID NO: 37567 - RNA, 17 nt, Homo sapiens
cauggagggacucagcc

SEQ ID NO: 37568 - RNA, 18 nt, Homo sapiens
cgcagccaauggucaagg

SEQ ID NO: 37569 - RNA, 16 nt, Homo sapiens
cuagugcucuccaccu

SEQ ID NO: 37570 - RNA, 20 nt, Homo sapiens
gcucugugggcuggggguua

SEQ ID NO: 37571 - RNA, 20 nt, Homo sapiens
ggaagcagaauccacuuggu

SEQ ID NO: 37572 - RNA, 19 nt, Homo sapiens
ggcagggggagaaacaaga

SEQ ID NO: 37573 - RNA, 19 nt, Homo sapiens
uccuucugaaaucauccuc

SEQ ID NO: 37574 - RNA, 18 nt, Homo sapiens
ugcugcuuguggcgcuuu

SEQ ID NO: 37575 - RNA, 19 nt, Homo sapiens
aggcaguacuuuuaccaug

SEQ ID NO: 37576 - RNA, 20 nt, Homo sapiens
acaucauuguaccuguaauc

SEQ ID NO: 37577 - RNA, 19 nt, Homo sapiens
aggagugugcucccuguau

SEQ ID NO: 37578 - RNA, 19 nt, Homo sapiens
aggauuccacauaauguca

SEQ ID NO: 37579 - RNA, 16 nt, Homo sapiens
agucacacugaaacaa

SEQ ID NO: 37580 - RNA, 16 nt, Homo sapiens
agucacauugaaacaa

SEQ ID NO: 37581 - RNA, 27 nt, Homo sapiens
auuuuguuucagucacacugaaacaaa

SEQ ID NO: 37582 - RNA, 27 nt, Homo sapiens
auuuuguuucagucacauugaaacaaa

SEQ ID NO: 37583 - RNA, 14 nt, Homo sapiens
cacauaccggggcc

SEQ ID NO: 37584 - RNA, 21 nt, Homo sapiens
cagggccacauaccacucccg

SEQ ID NO: 37585 - RNA, 24 nt, Homo sapiens
cauaaccauaaccaaauaauuuua

SEQ ID NO: 37586 - RNA, 22 nt, Homo sapiens
ccgcggggguccuaagugcauc

SEQ ID NO: 37587 - RNA, 23 nt, Homo sapiens
cuggaaaccaucauucucagcaa

SEQ ID NO: 37588 - RNA, 19 nt, Homo sapiens
cugugauuuauguccagca

SEQ ID NO: 37589 - RNA, 15 nt, Homo sapiens
gcagcacaccagcag

SEQ ID NO: 37590 - RNA, 23 nt, Homo sapiens
uaauaugcuaaucaaaucaaacc

SEQ ID NO: 37591 - RNA, 24 nt, Homo sapiens
uagcauuucauuuuaugcuauuua

SEQ ID NO: 37592 - RNA, 20 nt, Homo sapiens
ucaggacuaucaagaggcca

SEQ ID NO: 37593 - RNA, 18 nt, Homo sapiens
ucugugauuuauguccag

SEQ ID NO: 37594 - RNA, 19 nt, Homo sapiens
ucuugcugaacugaaggag

SEQ ID NO: 37595 - RNA, 16 nt, Homo sapiens
uggcgugguggcauga

SEQ ID NO: 37596 - RNA, 24 nt, Homo sapiens
ugucugcaauacuacuuuuuuuaa

SEQ ID NO: 37597 - RNA, 17 nt, Homo sapiens
uguguguacuauuuucc

SEQ ID NO: 37598 - RNA, 22 nt, Homo sapiens
auggugcuaauauuguagauaa

SEQ ID NO: 37599 - RNA, 19 nt, Homo sapiens
cagcgccuacucaggcccc

SEQ ID NO: 37600 - RNA, 17 nt, Homo sapiens
ccagcuugcuccucguc

SEQ ID NO: 37601 - RNA, 20 nt, Homo sapiens
cucguccucugugccugagc

SEQ ID NO: 37602 - RNA, 21 nt, Homo sapiens
cucuggcuccccucucccugg

SEQ ID NO: 37603 - RNA, 19 nt, Homo sapiens
gagugacgucuggcagccu

SEQ ID NO: 37604 - RNA, 24 nt, Homo sapiens
gcggguggagugacgucuggcagc

SEQ ID NO: 37605 - RNA, 16 nt, Homo sapiens
gcgguggaaagaugga

SEQ ID NO: 37606 - RNA, 19 nt, Homo sapiens
gcucuggcuccccucuccc

SEQ ID NO: 37607 - RNA, 19 nt, Homo sapiens
gggaagaccuugccuucgc

SEQ ID NO: 37608 - RNA, 21 nt, Homo sapiens
uagauugcaaaaauuuucucc

SEQ ID NO: 37609 - RNA, 23 nt, Homo sapiens
uggggguuuuacacauaaaaccc

SEQ ID NO: 37610 - RNA, 23 nt, Homo sapiens
ugugcagggggaggcccacuagc

SEQ ID NO: 37611 - RNA, 17 nt, Homo sapiens
uuuuaggccauuuuaca

SEQ ID NO: 37612 - RNA, 20 nt, Homo sapiens
gaggaagcgggagacccggc

SEQ ID NO: 37613 - RNA, 19 nt, Homo sapiens
aaguagccuauuccagggu

SEQ ID NO: 37614 - RNA, 19 nt, Homo sapiens
agccugugcuugaucccuc

SEQ ID NO: 37615 - RNA, 20 nt, Homo sapiens
cuuagaugguucugggguuc

SEQ ID NO: 37616 - RNA, 18 nt, Homo sapiens
gccugcucuuuccucucc

SEQ ID NO: 37617 - RNA, 19 nt, Homo sapiens
acggcauuauuucuuuaau

SEQ ID NO: 37618 - RNA, 19 nt, Homo sapiens
cucugcugcaggaauugca

SEQ ID NO: 37619 - RNA, 23 nt, Homo sapiens
ggagggcucagagcuggaggaga

SEQ ID NO: 37620 - RNA, 19 nt, Homo sapiens
uagaguggucuuaggcugg

SEQ ID NO: 37621 - RNA, 24 nt, Homo sapiens
ucucucagaccuaguguuuuccag

SEQ ID NO: 37622 - RNA, 26 nt, Homo sapiens
ugcugcacaacggguucgggcaaagc

SEQ ID NO: 37623 - RNA, 20 nt, Homo sapiens
uagaguauacuuuuguuguu

SEQ ID NO: 37624 - RNA, 20 nt, Homo sapiens
agcaauuuuaaacuuggauc

SEQ ID NO: 37625 - RNA, 15 nt, Homo sapiens
caucucuagcuguga

SEQ ID NO: 37626 - RNA, 18 nt, Homo sapiens
cauggguuucuuuagaaa

SEQ ID NO: 37627 - RNA, 19 nt, Homo sapiens
gcaauuuuaaacuuggauc

SEQ ID NO: 37628 - RNA, 18 nt, Homo sapiens
ucacagcauggguuucuu

SEQ ID NO: 37629 - RNA, 24 nt, Homo sapiens
ucuaacaguucuaaucucucuucu

SEQ ID NO: 37630 - RNA, 23 nt, Homo sapiens
ucucucuucuuuucaauacuuuc

SEQ ID NO: 37631 - RNA, 26 nt, Homo sapiens
ugagcucguccugcgucuugagcuug

SEQ ID NO: 37632 - RNA, 18 nt, Homo sapiens
ugaguuaucuaaaaugug

SEQ ID NO: 37633 - RNA, 16 nt, Homo sapiens
caggguccuacaugcc

SEQ ID NO: 37634 - RNA, 21 nt, Homo sapiens
ccagcuguacccuccuucccc

SEQ ID NO: 37635 - RNA, 21 nt, Homo sapiens
cccagggacuuccccuccccc

SEQ ID NO: 37636 - RNA, 19 nt, Homo sapiens
cccggcucagcgccuccuc

SEQ ID NO: 37637 - RNA, 20 nt, Homo sapiens
cuuccccucuggcagggaga

SEQ ID NO: 37638 - RNA, 20 nt, Homo sapiens
gggugcgagcugguauggau

SEQ ID NO: 37639 - RNA, 23 nt, Homo sapiens
ccacaaacucaguaggagugcaa

SEQ ID NO: 37640 - RNA, 19 nt, Homo sapiens
ccggagcuagacagccugg

SEQ ID NO: 37641 - RNA, 21 nt, Homo sapiens
gcccgcucgucccugcugacc

SEQ ID NO: 37642 - RNA, 24 nt, Homo sapiens
gccucucagaccaggccucugcca

SEQ ID NO: 37643 - RNA, 15 nt, Homo sapiens
gcugcaguucaaaga

SEQ ID NO: 37644 - RNA, 18 nt, Homo sapiens
ggggccuaagcagggccu

SEQ ID NO: 37645 - RNA, 15 nt, Homo sapiens
ucgugcagggcuggu

SEQ ID NO: 37646 - RNA, 18 nt, Homo sapiens
uggugucugcugugguuc

SEQ ID NO: 37647 - RNA, 24 nt, Homo sapiens
uugcugugcaaccuugggcaacgu

SEQ ID NO: 37648 - RNA, 19 nt, Homo sapiens
acagggcgagugcagcugg

SEQ ID NO: 37649 - RNA, 18 nt, Homo sapiens
aggagaaacaggaacacc

SEQ ID NO: 37650 - RNA, 19 nt, Homo sapiens
aggagaaacaggaacaccc

SEQ ID NO: 37651 - RNA, 18 nt, Homo sapiens
aggcaggcucggggcugg

SEQ ID NO: 37652 - RNA, 16 nt, Homo sapiens
caccccgaaccagucc

SEQ ID NO: 37653 - RNA, 17 nt, Homo sapiens
cuuuaccaagggagggg

SEQ ID NO: 37654 - RNA, 21 nt, Homo sapiens
gcucgcucgcucgcuggcucu

SEQ ID NO: 37655 - RNA, 21 nt, Homo sapiens
gcucgcucgcuggcucucgcc

SEQ ID NO: 37656 - RNA, 20 nt, Homo sapiens
gcucucgcccgucggcgccc

SEQ ID NO: 37657 - RNA, 21 nt, Homo sapiens
gcugggaaagggcggugcugc

SEQ ID NO: 37658 - RNA, 18 nt, Homo sapiens
gcuguucacuccaaagcc

SEQ ID NO: 37659 - RNA, 21 nt, Homo sapiens
ugagguaacuggguugagucc

SEQ ID NO: 37660 - RNA, 19 nt, Homo sapiens
uggcuugcagggugcugcu

SEQ ID NO: 37661 - RNA, 17 nt, Homo sapiens
uggugcagaacuggugc

SEQ ID NO: 37662 - RNA, 17 nt, Homo sapiens
uugggugucccuaaaug

SEQ ID NO: 37663 - RNA, 22 nt, Homo sapiens
uuugauguguuuccaaaaauca

SEQ ID NO: 37664 - RNA, 17 nt, Homo sapiens
cccguggaacgucgugc

SEQ ID NO: 37665 - RNA, 20 nt, Homo sapiens
aauuucuuuagcaaaaaccu

SEQ ID NO: 37666 - RNA, 20 nt, Homo sapiens
acuaccaccaucugucuuaa

SEQ ID NO: 37667 - RNA, 19 nt, Homo sapiens
agaguuaucaaagauuggg

SEQ ID NO: 37668 - RNA, 24 nt, Homo sapiens
agaugaaauuaaagcuuaaguuuu

SEQ ID NO: 37669 - RNA, 18 nt, Homo sapiens
ggugaguagucggagagc

SEQ ID NO: 37670 - RNA, 19 nt, Homo sapiens
guaauccacauaagauaua

SEQ ID NO: 37671 - RNA, 15 nt, Homo sapiens
uggaauaugacacuc

SEQ ID NO: 37672 - RNA, 19 nt, Homo sapiens
ugucauuaugcaguacaua

SEQ ID NO: 37673 - RNA, 22 nt, Homo sapiens
uugugaacuacucugaaacaga

SEQ ID NO: 37674 - RNA, 20 nt, Homo sapiens
aggaguguggcucaguccaa

SEQ ID NO: 37675 - RNA, 19 nt, Homo sapiens
aggaugguaacacccauca

SEQ ID NO: 37676 - RNA, 19 nt, Homo sapiens
aguggcugguccccauuga

SEQ ID NO: 37677 - RNA, 17 nt, Homo sapiens
caccgacauucuggcgu

SEQ ID NO: 37678 - RNA, 17 nt, Homo sapiens
cagaagggauguccugc

SEQ ID NO: 37679 - RNA, 19 nt, Homo sapiens
cagcagauucugcacucca

SEQ ID NO: 37680 - RNA, 20 nt, Homo sapiens
cauugaucaaaaacaaggga

SEQ ID NO: 37681 - RNA, 15 nt, Homo sapiens
gaaacuuggguugug

SEQ ID NO: 37682 - RNA, 20 nt, Homo sapiens
gaggugggagaggagacccg

SEQ ID NO: 37683 - RNA, 20 nt, Homo sapiens
gaguaccgagccgauaacau

SEQ ID NO: 37684 - RNA, 17 nt, Homo sapiens
guaccucucgcagcugc

SEQ ID NO: 37685 - RNA, 22 nt, Homo sapiens
gugggagugguucaagucaggg

SEQ ID NO: 37686 - RNA, 16 nt, Homo sapiens
uguauggaccacuugc

SEQ ID NO: 37687 - RNA, 20 nt, Homo sapiens
gaguaccgagccgauaacau

SEQ ID NO: 37688 - RNA, 18 nt, Homo sapiens
acuugagggcucgggcgu

SEQ ID NO: 37689 - RNA, 23 nt, Homo sapiens
cccuucgccuuccucaacguggc

SEQ ID NO: 37690 - RNA, 19 nt, Homo sapiens
gguuaggaaaggcccucag

SEQ ID NO: 37691 - RNA, 20 nt, Homo sapiens
gguuaggaaaggcccucagg

SEQ ID NO: 37692 - RNA, 22 nt, Homo sapiens
gcugucagccccauugucccuu

SEQ ID NO: 37693 - RNA, 19 nt, Homo sapiens
accaggaacugcuaagaag

SEQ ID NO: 37694 - RNA, 18 nt, Homo sapiens
agcagggauuacaggcac

SEQ ID NO: 37695 - RNA, 17 nt, Homo sapiens
cacauuucugacuggag

SEQ ID NO: 37696 - RNA, 22 nt, Homo sapiens
cagcugggcacucuggguuucc

SEQ ID NO: 37697 - RNA, 18 nt, Homo sapiens
caugacauucuggaggcu

SEQ ID NO: 37698 - RNA, 22 nt, Homo sapiens
ccagaugagaucuggcugggug

SEQ ID NO: 37699 - RNA, 21 nt, Homo sapiens
ccuuggcaacaucuggaucua

SEQ ID NO: 37700 - RNA, 14 nt, Homo sapiens
cuguaggcgugauu

SEQ ID NO: 37701 - RNA, 19 nt, Homo sapiens
gacuagcccuggucacaca

SEQ ID NO: 37702 - RNA, 21 nt, Homo sapiens
ggacugaaacugccgcuuucu

SEQ ID NO: 37703 - RNA, 20 nt, Homo sapiens
uagcaacugucaccugcuga

SEQ ID NO: 37704 - RNA, 18 nt, Homo sapiens
uagugagauucuuguucc

SEQ ID NO: 37705 - RNA, 17 nt, Homo sapiens
ucaggaccucagacucc

SEQ ID NO: 37706 - RNA, 22 nt, Homo sapiens
ucaggaccucagacuccccaga

SEQ ID NO: 37707 - RNA, 16 nt, Homo sapiens
ucaguuuuauaugguu

SEQ ID NO: 37708 - RNA, 20 nt, Homo sapiens
ucugcaagcaauuugccaua

SEQ ID NO: 37709 - RNA, 20 nt, Homo sapiens
ucugcuuucuuucaggaccu

SEQ ID NO: 37710 - RNA, 15 nt, Homo sapiens
ugaggcccgccuaac

SEQ ID NO: 37711 - RNA, 20 nt, Homo sapiens
uugaaacuagccuaggagag

SEQ ID NO: 37712 - RNA, 19 nt, Homo sapiens
uuggccccugcagcugugg

SEQ ID NO: 37713 - RNA, 24 nt, Homo sapiens
uuugcaagguucugucugccuggu

SEQ ID NO: 37714 - RNA, 18 nt, Homo sapiens
uguguaccaaaugcucuu

SEQ ID NO: 37715 - RNA, 23 nt, Homo sapiens
caguuuuuuaauccauuagcugg

SEQ ID NO: 37716 - RNA, 16 nt, Homo sapiens
cauuuucccauguugu

SEQ ID NO: 37717 - RNA, 19 nt, Homo sapiens
ccuauggugugguuuuggu

SEQ ID NO: 37718 - RNA, 17 nt, Homo sapiens
uccguggaugggagggg

SEQ ID NO: 37719 - RNA, 19 nt, Homo sapiens
ugagaacuguuuucaccaa

SEQ ID NO: 37720 - RNA, 20 nt, Homo sapiens
aagcugaaggggaggcguga

SEQ ID NO: 37721 - RNA, 22 nt, Homo sapiens
acacagacuucaccagugugaa

SEQ ID NO: 37722 - RNA, 20 nt, Homo sapiens
agggaggaggaggaaggggc

SEQ ID NO: 37723 - RNA, 15 nt, Homo sapiens
caagcagaggugucu

SEQ ID NO: 37724 - RNA, 17 nt, Homo sapiens
ccagggggaacaccugc

SEQ ID NO: 37725 - RNA, 19 nt, Homo sapiens
ccucucugcccaccagaga

SEQ ID NO: 37726 - RNA, 18 nt, Homo sapiens
cugugauggguggggccu

SEQ ID NO: 37727 - RNA, 22 nt, Homo sapiens
gaaggaggggcuaauaggaguc

SEQ ID NO: 37728 - RNA, 21 nt, Homo sapiens
gccgcagguccuggacuacau

SEQ ID NO: 37729 - RNA, 18 nt, Homo sapiens
gccugcuugacgggcgcc

SEQ ID NO: 37730 - RNA, 19 nt, Homo sapiens
ggacacuagagcuuaggaa

SEQ ID NO: 37731 - RNA, 16 nt, Homo sapiens
ggccgcucugaccgug

SEQ ID NO: 37732 - RNA, 27 nt, Homo sapiens
ggcgaggagugggcuggcgaggagugg

SEQ ID NO: 37733 - RNA, 28 nt, Homo sapiens
ggcgaggagugggcuggcgaggaguggg

SEQ ID NO: 37734 - RNA, 20 nt, Homo sapiens
gggcuggcgaggacuguggc

SEQ ID NO: 37735 - RNA, 21 nt, Homo sapiens
ggucacuacccacgaggccac

SEQ ID NO: 37736 - RNA, 19 nt, Homo sapiens
ucgauucucgguuuagauc

SEQ ID NO: 37737 - RNA, 19 nt, Homo sapiens
ucucguccaggacccugag

SEQ ID NO: 37738 - RNA, 24 nt, Homo sapiens
ucugggaugaaaggagaagggaac

SEQ ID NO: 37739 - RNA, 24 nt, Homo sapiens
ugaggcucagcaucggggguggca

SEQ ID NO: 37740 - RNA, 20 nt, Homo sapiens
ugccaugggcugccagggcu

SEQ ID NO: 37741 - RNA, 19 nt, Homo sapiens
ugcugugauggguggggcc

SEQ ID NO: 37742 - RNA, 24 nt, Homo sapiens
uggaaggaggggcuaauaggaguc

SEQ ID NO: 37743 - RNA, 18 nt, Homo sapiens
uggacucacugcugcugu

SEQ ID NO: 37744 - RNA, 22 nt, Homo sapiens
uggcccugguguagugggaggg

SEQ ID NO: 37745 - RNA, 19 nt, Homo sapiens
uggggaggccaagcugggg

SEQ ID NO: 37746 - RNA, 20 nt, Homo sapiens
ugugacaguggaggcagggc

SEQ ID NO: 37747 - RNA, 20 nt, Homo sapiens
ugugagagccagcacuccgg

SEQ ID NO: 37748 - RNA, 21 nt, Homo sapiens
uguggcucggcggucuccaug

SEQ ID NO: 37749 - RNA, 22 nt, Homo sapiens
uuucucugcuguuccacacugc

SEQ ID NO: 37750 - RNA, 23 nt, Homo sapiens
accccagcuuaguuucgauucuc

SEQ ID NO: 37751 - RNA, 15 nt, Homo sapiens
cccuuggaggagcag

SEQ ID NO: 37752 - RNA, 18 nt, Homo sapiens
cuccuggcccugguguag

SEQ ID NO: 37753 - RNA, 18 nt, Homo sapiens
cugucagcagguguccag

SEQ ID NO: 37754 - RNA, 18 nt, Homo sapiens
cugugauggguggggccu

SEQ ID NO: 37755 - RNA, 24 nt, Homo sapiens
ggcgaggagugggcuggcgaggag

SEQ ID NO: 37756 - RNA, 27 nt, Homo sapiens
ggcgaggagugggcuggcgaggagugg

SEQ ID NO: 37757 - RNA, 16 nt, Homo sapiens
uggggcaagaccaggg

SEQ ID NO: 37758 - RNA, 17 nt, Homo sapiens
aagcaaugggaagcucu

SEQ ID NO: 37759 - RNA, 17 nt, Homo sapiens
aagccacaggaagcucu

SEQ ID NO: 37760 - RNA, 19 nt, Homo sapiens
aagguugggccacaggaaa

SEQ ID NO: 37761 - RNA, 16 nt, Homo sapiens
augcacuuccuugcuc

SEQ ID NO: 37762 - RNA, 14 nt, Homo sapiens
cacagcucaggauu

SEQ ID NO: 37763 - RNA, 16 nt, Homo sapiens
caccacacggcccucc

SEQ ID NO: 37764 - RNA, 18 nt, Homo sapiens
caguggcuggcuugaccc

SEQ ID NO: 37765 - RNA, 17 nt, Homo sapiens
caugcagucacuauggc

SEQ ID NO: 37766 - RNA, 25 nt, Homo sapiens
cccgaaggucaggacugcugagggu

SEQ ID NO: 37767 - RNA, 16 nt, Homo sapiens
ccucugcaguguccag

SEQ ID NO: 37768 - RNA, 20 nt, Homo sapiens
gcagggguuuggggagaggu

SEQ ID NO: 37769 - RNA, 17 nt, Homo sapiens
gcuuugcaaaaaccguc

SEQ ID NO: 37770 - RNA, 20 nt, Homo sapiens
ggagauuuuuggagaugugg

SEQ ID NO: 37771 - RNA, 19 nt, Homo sapiens
ggaggagggugggaggagc

SEQ ID NO: 37772 - RNA, 20 nt, Homo sapiens
gggccacaggaaaggugggg

SEQ ID NO: 37773 - RNA, 16 nt, Homo sapiens
ggggaccuuuccaguu

SEQ ID NO: 37774 - RNA, 18 nt, Homo sapiens
uacucuggucacacuccu

SEQ ID NO: 37775 - RNA, 17 nt, Homo sapiens
uagaguaaggaggaaga

SEQ ID NO: 37776 - RNA, 19 nt, Homo sapiens
ucaggguuccauggucaug

SEQ ID NO: 37777 - RNA, 19 nt, Homo sapiens
uccagagucaggagucgca

SEQ ID NO: 37778 - RNA, 18 nt, Homo sapiens
ucgcaaccuuuggcauca

SEQ ID NO: 37779 - RNA, 19 nt, Homo sapiens
ucuccacagcaaggaugac

SEQ ID NO: 37780 - RNA, 17 nt, Homo sapiens
ugagaggacgcguuggg

SEQ ID NO: 37781 - RNA, 23 nt, Homo sapiens
ugcuggccuugagcaucuccauc

SEQ ID NO: 37782 - RNA, 21 nt, Homo sapiens
ugggaggagcucagaggcggc

SEQ ID NO: 37783 - RNA, 20 nt, Homo sapiens
aaaggaacuauuaaaaggaa

SEQ ID NO: 37784 - RNA, 20 nt, Homo sapiens
gagacaaaaggaaaauugau

SEQ ID NO: 37785 - RNA, 20 nt, Homo sapiens
gggagcgggaaauaggagaa

SEQ ID NO: 37786 - RNA, 18 nt, Homo sapiens
ucgcagucuucagagcgg

SEQ ID NO: 37787 - RNA, 19 nt, Homo sapiens
ucauuuuucuaccagauuu

SEQ ID NO: 37788 - RNA, 22 nt, Homo sapiens
uuuuuuuuuuuuuucauuuuuc

SEQ ID NO: 37789 - RNA, 19 nt, Homo sapiens
cauacacucacacagaccc

SEQ ID NO: 37790 - RNA, 19 nt, Homo sapiens
cccgccccggcuccucggc

SEQ ID NO: 37791 - RNA, 15 nt, Homo sapiens
ccgccgcugccgccc

SEQ ID NO: 37792 - RNA, 19 nt, Homo sapiens
cggugacgcucggcggcgg

SEQ ID NO: 37793 - RNA, 18 nt, Homo sapiens
gaaaagagaaauaagaga

SEQ ID NO: 37794 - RNA, 15 nt, Homo sapiens
gcccgccccggcucc

SEQ ID NO: 37795 - RNA, 14 nt, Homo sapiens
gccgcccgccccgg

SEQ ID NO: 37796 - RNA, 19 nt, Homo sapiens
gccgcugcccccgccgccg

SEQ ID NO: 37797 - RNA, 23 nt, Homo sapiens
gcgccgccgccgccgcgucucag

SEQ ID NO: 37798 - RNA, 23 nt, Homo sapiens
gcucaggcugggcgcgcggcccc

SEQ ID NO: 37799 - RNA, 18 nt, Homo sapiens
ucacacacauacacauau

SEQ ID NO: 37800 - RNA, 22 nt, Homo sapiens
uuacugaauucaacccaagugu

SEQ ID NO: 37801 - RNA, 18 nt, Homo sapiens
uuccugacuuccuggggu

SEQ ID NO: 37802 - RNA, 26 nt, Homo sapiens
accauggagagaaugugugugugugu

SEQ ID NO: 37803 - RNA, 18 nt, Homo sapiens
aggggcgcgcggggcugc

SEQ ID NO: 37804 - RNA, 21 nt, Homo sapiens
aggggcgcgcggggcugccgg

SEQ ID NO: 37805 - RNA, 17 nt, Homo sapiens
caguaacaguaacaugu

SEQ ID NO: 37806 - RNA, 15 nt, Homo sapiens
ccgaagcugggugcg

SEQ ID NO: 37807 - RNA, 20 nt, Homo sapiens
cgcggaggcgggagcgcggg

SEQ ID NO: 37808 - RNA, 20 nt, Homo sapiens
gccaccucccgggcuggcgc

SEQ ID NO: 37809 - RNA, 18 nt, Homo sapiens
gcgcggaggcgggagcgc

SEQ ID NO: 37810 - RNA, 19 nt, Homo sapiens
gcugggggugagagcgcgc

SEQ ID NO: 37811 - RNA, 21 nt, Homo sapiens
aggcggagcgcggugcagacc

SEQ ID NO: 37812 - RNA, 19 nt, Homo sapiens
auaaauggacauaugggca

SEQ ID NO: 37813 - RNA, 23 nt, Homo sapiens
caauacaaagcuauaaaauauau

SEQ ID NO: 37814 - RNA, 21 nt, Homo sapiens
ggcggcuucagcugcggcgcc

SEQ ID NO: 37815 - RNA, 23 nt, Homo sapiens
guggagaugaauuaugggcagcc

SEQ ID NO: 37816 - RNA, 20 nt, Homo sapiens
uaccacugaggcaauguugg

SEQ ID NO: 37817 - RNA, 19 nt, Homo sapiens
uauaaaauauauaaaagca

SEQ ID NO: 37818 - RNA, 15 nt, Homo sapiens
uugauuucuuaccca

SEQ ID NO: 37819 - RNA, 17 nt, Homo sapiens
uugcugugugucuucag

SEQ ID NO: 37820 - RNA, 20 nt, Homo sapiens
uugcugugugucuucaggca

SEQ ID NO: 37821 - RNA, 19 nt, Homo sapiens
ugugauuucugccucugug

SEQ ID NO: 37822 - RNA, 23 nt, Homo sapiens
uuagugcauuccaacaggugaga

SEQ ID NO: 37823 - RNA, 19 nt, Homo sapiens
uuuauugggggauauuugg

SEQ ID NO: 37824 - RNA, 20 nt, Homo sapiens
agggguugcagcaggggcca

SEQ ID NO: 37825 - RNA, 20 nt, Homo sapiens
caauauugagugaugacauu

SEQ ID NO: 37826 - RNA, 21 nt, Homo sapiens
ccuuggaccggagcccagugu

SEQ ID NO: 37827 - RNA, 18 nt, Homo sapiens
cgcagcggugcagaccgu

SEQ ID NO: 37828 - RNA, 20 nt, Homo sapiens
cgcccgcagcggugcagacc

SEQ ID NO: 37829 - RNA, 16 nt, Homo sapiens
cgggcaaaaccaggga

SEQ ID NO: 37830 - RNA, 20 nt, Homo sapiens
cuccagccuuccccuuaccu

SEQ ID NO: 37831 - RNA, 15 nt, Homo sapiens
gaccguuuucauuua

SEQ ID NO: 37832 - RNA, 16 nt, Homo sapiens
gaggaggcggagaggc

SEQ ID NO: 37833 - RNA, 22 nt, Homo sapiens
gccaaugugugugcagaggcug

SEQ ID NO: 37834 - RNA, 17 nt, Homo sapiens
gccagaggugcccccac

SEQ ID NO: 37835 - RNA, 17 nt, Homo sapiens
gcccggcccucagcccc

SEQ ID NO: 37836 - RNA, 23 nt, Homo sapiens
gcccggguuccagcacggccucg

SEQ ID NO: 37837 - RNA, 23 nt, Homo sapiens
gggccgggcggggggcuccuggg

SEQ ID NO: 37838 - RNA, 15 nt, Homo sapiens
gggugcccggggacc

SEQ ID NO: 37839 - RNA, 18 nt, Homo sapiens
gugaggaaagagaggagg

SEQ ID NO: 37840 - RNA, 16 nt, Homo sapiens
ugaccgaccugggugc

SEQ ID NO: 37841 - RNA, 19 nt, Homo sapiens
uggcagaggagccggagag

SEQ ID NO: 37842 - RNA, 19 nt, Homo sapiens
ugggaggccgaaagagagc

SEQ ID NO: 37843 - RNA, 18 nt, Homo sapiens
agaggccgggggcgggga

SEQ ID NO: 37844 - RNA, 23 nt, Homo sapiens
aagggccauugugcuucuguggc

SEQ ID NO: 37845 - RNA, 19 nt, Homo sapiens
cuucuguggcugggccguc

SEQ ID NO: 37846 - RNA, 23 nt, Homo sapiens
gaacccaggcccuucccucagug

SEQ ID NO: 37847 - RNA, 16 nt, Homo sapiens
ucucccugugucuguu

SEQ ID NO: 37848 - RNA, 23 nt, Homo sapiens
gcccuggguagggccgggcgggg

SEQ ID NO: 37849 - RNA, 19 nt, Homo sapiens
aggggggcagguagggugg

SEQ ID NO: 37850 - RNA, 18 nt, Homo sapiens
ccaaagcacugagcagcc

SEQ ID NO: 37851 - RNA, 19 nt, Homo sapiens
cccuuugaucucgcucucc

SEQ ID NO: 37852 - RNA, 16 nt, Homo sapiens
cugagcagccaagccc

SEQ ID NO: 37853 - RNA, 18 nt, Homo sapiens
ucugcucucccacugcuu

SEQ ID NO: 37854 - RNA, 18 nt, Homo sapiens
uggccggcccccuccccc

SEQ ID NO: 37855 - RNA, 23 nt, Homo sapiens
cagcccuuucuagagguauuaau

SEQ ID NO: 37856 - RNA, 17 nt, Homo sapiens
ccaagaagaaauccccc

SEQ ID NO: 37857 - RNA, 18 nt, Homo sapiens
ggaaugaacugcccuguu

SEQ ID NO: 37858 - RNA, 17 nt, Homo sapiens
gaggaggugcugugugg

SEQ ID NO: 37859 - RNA, 18 nt, Homo sapiens
ggccaggaggaggugcug

SEQ ID NO: 37860 - RNA, 20 nt, Homo sapiens
uccuggcugcuuccuccuca

SEQ ID NO: 37861 - RNA, 22 nt, Homo sapiens
uggggaggagaaggugcugggg

SEQ ID NO: 37862 - RNA, 20 nt, Homo sapiens
ggccgcgggcggcagggugc

SEQ ID NO: 37863 - RNA, 18 nt, Homo sapiens
aaacacaguuauucacag

SEQ ID NO: 37864 - RNA, 20 nt, Homo sapiens
aaagauuucaaacaaauuuu

SEQ ID NO: 37865 - RNA, 18 nt, Homo sapiens
aagcucuucaaaggucgu

SEQ ID NO: 37866 - RNA, 20 nt, Homo sapiens
aguuaucccccugacaagcc

SEQ ID NO: 37867 - RNA, 18 nt, Homo sapiens
auucccaaagccuuaagc

SEQ ID NO: 37868 - RNA, 19 nt, Homo sapiens
auucccaaagccuuaagca

SEQ ID NO: 37869 - RNA, 18 nt, Homo sapiens
caggggcugcucagacag

SEQ ID NO: 37870 - RNA, 18 nt, Homo sapiens
cauuugaauuuuuaaaag

SEQ ID NO: 37871 - RNA, 19 nt, Homo sapiens
cauuugaauuuuuaaaaga

SEQ ID NO: 37872 - RNA, 20 nt, Homo sapiens
gaacugagaugucagcucau

SEQ ID NO: 37873 - RNA, 21 nt, Homo sapiens
gcgugaacccgggaggcggag

SEQ ID NO: 37874 - RNA, 19 nt, Homo sapiens
gcuuacuucauaguucacu

SEQ ID NO: 37875 - RNA, 18 nt, Homo sapiens
ggggacggggucuugcuc

SEQ ID NO: 37876 - RNA, 20 nt, Homo sapiens
guggaucacgaggucaggag

SEQ ID NO: 37877 - RNA, 22 nt, Homo sapiens
uaacuuuagcucuuauaaaaaa

SEQ ID NO: 37878 - RNA, 23 nt, Homo sapiens
uaacuuuagcucuuauaaaaaag

SEQ ID NO: 37879 - RNA, 19 nt, Homo sapiens
uaagagaaaggagacagug

SEQ ID NO: 37880 - RNA, 21 nt, Homo sapiens
ucccuccauggccucacuucc

SEQ ID NO: 37881 - RNA, 19 nt, Homo sapiens
ugguaguguggaauuuagc

SEQ ID NO: 37882 - RNA, 17 nt, Homo sapiens
uugggaggccgaggugg

SEQ ID NO: 37883 - RNA, 23 nt, Homo sapiens
uaacuuuagcucuuauaaaaaag

SEQ ID NO: 37884 - RNA, 24 nt, Homo sapiens
uccacccuuuccuggcaccaucgc

SEQ ID NO: 37885 - RNA, 21 nt, Homo sapiens
aaucaacugcaugcaccaaaa

SEQ ID NO: 37886 - RNA, 21 nt, Homo sapiens
ccucuggccccgccgccgccu

SEQ ID NO: 37887 - RNA, 18 nt, Homo sapiens
ucgccgccgccacugccc

SEQ ID NO: 37888 - RNA, 21 nt, Homo sapiens
uguaacuuuacauucaucagg

SEQ ID NO: 37889 - RNA, 23 nt, Homo sapiens
uugcucaucuuuucuuuauguuu

SEQ ID NO: 37890 - RNA, 19 nt, Homo sapiens
aaaugcuccccgauccgcu

SEQ ID NO: 37891 - RNA, 18 nt, Homo sapiens
gggcacccuuugcacccc

SEQ ID NO: 37892 - RNA, 15 nt, Homo sapiens
ucgcggacacgcuga

SEQ ID NO: 37893 - RNA, 21 nt, Homo sapiens
uuaauagugguccugauggaa

SEQ ID NO: 37894 - RNA, 18 nt, Homo sapiens
acuagucagcauguuauc

SEQ ID NO: 37895 - RNA, 19 nt, Homo sapiens
acuugauguaggaauauaa

SEQ ID NO: 37896 - RNA, 17 nt, Homo sapiens
auuugguauguaacaug

SEQ ID NO: 37897 - RNA, 21 nt, Homo sapiens
cccgggauacagcaggauuag

SEQ ID NO: 37898 - RNA, 18 nt, Homo sapiens
gcaggauuaguagcaccg

SEQ ID NO: 37899 - RNA, 20 nt, Homo sapiens
uauauauauauauaucacau

SEQ ID NO: 37900 - RNA, 22 nt, Homo sapiens
uucccaguucuguacaagcaga

SEQ ID NO: 37901 - RNA, 17 nt, Homo sapiens
cuugccucugucccaga

SEQ ID NO: 37902 - RNA, 24 nt, Homo sapiens
ucucaggaaggcugcccaggucag

SEQ ID NO: 37903 - RNA, 20 nt, Homo sapiens
caccccagcuuccccgccca

SEQ ID NO: 37904 - RNA, 20 nt, Homo sapiens
ccccagcugggguccguccc

SEQ ID NO: 37905 - RNA, 16 nt, Homo sapiens
gccggagcgcggccgc

SEQ ID NO: 37906 - RNA, 25 nt, Homo sapiens
ucggaggcucucugguacugcuuuu

SEQ ID NO: 37907 - RNA, 21 nt, Homo sapiens
caggaccccaggccuggcggc

SEQ ID NO: 37908 - RNA, 16 nt, Homo sapiens
uggaaggcgauuugca

SEQ ID NO: 37909 - RNA, 18 nt, Homo sapiens
aaaggccuugucacauuc

SEQ ID NO: 37910 - RNA, 20 nt, Homo sapiens
ggguugagaacuuuuaaagg

SEQ ID NO: 37911 - RNA, 20 nt, Homo sapiens
ccgcccgugccgccgccgcc

SEQ ID NO: 37912 - RNA, 20 nt, Homo sapiens
gccgccgccgccgccgccgg

SEQ ID NO: 37913 - RNA, 22 nt, Homo sapiens
uccucuuguuccuuccuucguu

SEQ ID NO: 37914 - RNA, 22 nt, Homo sapiens
aacacagcaagauagauguuuu

SEQ ID NO: 37915 - RNA, 15 nt, Homo sapiens
cagcugcuguagccg

SEQ ID NO: 37916 - RNA, 19 nt, Homo sapiens
cuggcggucggggucgcgg

SEQ ID NO: 37917 - RNA, 21 nt, Homo sapiens
gcgccggcaggcccuggcgcc

SEQ ID NO: 37918 - RNA, 18 nt, Homo sapiens
ggggcggcaggcgugggg

SEQ ID NO: 37919 - RNA, 22 nt, Homo sapiens
gucugcuggugauaauacauuu

SEQ ID NO: 37920 - RNA, 17 nt, Homo sapiens
uccagccaauaaauaac

SEQ ID NO: 37921 - RNA, 19 nt, Homo sapiens
ucgcuggcagaucugcccc

SEQ ID NO: 37922 - RNA, 22 nt, Homo sapiens
uugaagagagaagugcuggaga

SEQ ID NO: 37923 - RNA, 22 nt, Homo sapiens
uugaagagagaagugcuggaga

SEQ ID NO: 37924 - RNA, 17 nt, Homo sapiens
ccccuuggggcagaggc

SEQ ID NO: 37925 - RNA, 14 nt, Homo sapiens
cuguuccccagcgg

SEQ ID NO: 37926 - RNA, 18 nt, Homo sapiens
gcccgccuguggcagcaa

SEQ ID NO: 37927 - RNA, 22 nt, Homo sapiens
gcccgccuguggcagcaacggc

SEQ ID NO: 37928 - RNA, 20 nt, Homo sapiens
gcugggaccccucagccuuc

SEQ ID NO: 37929 - RNA, 17 nt, Homo sapiens
gggagcacuuccccaug

SEQ ID NO: 37930 - RNA, 19 nt, Homo sapiens
ggugugcugaaugcugcuu

SEQ ID NO: 37931 - RNA, 20 nt, Homo sapiens
uaugggagcugaagauguag

SEQ ID NO: 37932 - RNA, 19 nt, Homo sapiens
ugaugggguugucccuugg

SEQ ID NO: 37933 - RNA, 21 nt, Homo sapiens
uuugggguuugagguucaguc

SEQ ID NO: 37934 - RNA, 18 nt, Homo sapiens
acuuuuucuuuccgagac

SEQ ID NO: 37935 - RNA, 14 nt, Homo sapiens
caacucgaaccgcu

SEQ ID NO: 37936 - RNA, 23 nt, Homo sapiens
ccugcgggccucccgcuccuugc

SEQ ID NO: 37937 - RNA, 18 nt, Homo sapiens
ccuguucuucucgauguc

SEQ ID NO: 37938 - RNA, 21 nt, Homo sapiens
cuuuuaacugugcuggcuucu

SEQ ID NO: 37939 - RNA, 18 nt, Homo sapiens
gccgcuccuccgcccgcc

SEQ ID NO: 37940 - RNA, 18 nt, Homo sapiens
gcucccgcugcuccuucu

SEQ ID NO: 37941 - RNA, 21 nt, Homo sapiens
gcuggcuucugcgcacgcgcc

SEQ ID NO: 37942 - RNA, 20 nt, Homo sapiens
uccauugagucuucucuucu

SEQ ID NO: 37943 - RNA, 22 nt, Homo sapiens
uccucuuguuccuuccuucguu

SEQ ID NO: 37944 - RNA, 20 nt, Homo sapiens
ucgugcucucuuucuuucac

SEQ ID NO: 37945 - RNA, 20 nt, Homo sapiens
ccgcggccgccgccucucca

SEQ ID NO: 37946 - RNA, 17 nt, Homo sapiens
cgcccccuugcgcaugc

SEQ ID NO: 37947 - RNA, 20 nt, Homo sapiens
cgccucagcagccgcggccg

SEQ ID NO: 37948 - RNA, 18 nt, Homo sapiens
ugaguaaagugcaugaaa

SEQ ID NO: 37949 - RNA, 19 nt, Homo sapiens
ugaugacauagggacagug

SEQ ID NO: 37950 - RNA, 19 nt, Homo sapiens
uucaaucugcucaugcauu

SEQ ID NO: 37951 - RNA, 18 nt, Homo sapiens
uucuauaauccuaaagaa

SEQ ID NO: 37952 - RNA, 22 nt, Homo sapiens
uugcauaauuuaacuguucaua

SEQ ID NO: 37953 - RNA, 21 nt, Homo sapiens
uuuauuuauacauuucuucaa

SEQ ID NO: 37954 - RNA, 20 nt, Homo sapiens
acaggugugagccaccacgc

SEQ ID NO: 37955 - RNA, 24 nt, Homo sapiens
accacgccuggccagaauucuacc

SEQ ID NO: 37956 - RNA, 23 nt, Homo sapiens
cacagguuucucaucaaaaagac

SEQ ID NO: 37957 - RNA, 18 nt, Homo sapiens
cacuauauuguccaggcu

SEQ ID NO: 37958 - RNA, 19 nt, Homo sapiens
cccaggcagauauucaagg

SEQ ID NO: 37959 - RNA, 19 nt, Homo sapiens
cuugaacuccugaccuugu

SEQ ID NO: 37960 - RNA, 17 nt, Homo sapiens
cuuuuguccaguguuaa

SEQ ID NO: 37961 - RNA, 19 nt, Homo sapiens
gaacuccugaccuugugau

SEQ ID NO: 37962 - RNA, 18 nt, Homo sapiens
ggcaaaagaaagugucac

SEQ ID NO: 37963 - RNA, 21 nt, Homo sapiens
ggguuccgccgcucagcugcc

SEQ ID NO: 37964 - RNA, 22 nt, Homo sapiens
uaauaucugcccccaggcagau

SEQ ID NO: 37965 - RNA, 18 nt, Homo sapiens
ucuggggggcaaaagaaa

SEQ ID NO: 37966 - RNA, 18 nt, Homo sapiens
uggcaaaccaagggaaga

SEQ ID NO: 37967 - RNA, 18 nt, Homo sapiens
ugugauccgccugccuug

SEQ ID NO: 37968 - RNA, 15 nt, Homo sapiens
ccagaaaaaugacuu

SEQ ID NO: 37969 - RNA, 20 nt, Homo sapiens
ucucuucuucuuuuccuucu

SEQ ID NO: 37970 - RNA, 23 nt, Homo sapiens
ucuucuuuuccuucuuagucugu

SEQ ID NO: 37971 - RNA, 21 nt, Homo sapiens
acgcacccaccccucuacuuc

SEQ ID NO: 37972 - RNA, 17 nt, Homo sapiens
agcuuuccgaucaagac

SEQ ID NO: 37973 - RNA, 24 nt, Homo sapiens
agggaaacaggcucagcggugccc

SEQ ID NO: 37974 - RNA, 19 nt, Homo sapiens
gaggugacuguugugaggg

SEQ ID NO: 37975 - RNA, 20 nt, Homo sapiens
gaugcuuggaggcuguuucc

SEQ ID NO: 37976 - RNA, 21 nt, Homo sapiens
ucccgggagacugcuaagcgg

SEQ ID NO: 37977 - RNA, 23 nt, Homo sapiens
ucugggcuacuuggguggcaccc

SEQ ID NO: 37978 - RNA, 15 nt, Homo sapiens
ugacgaguguccggu

SEQ ID NO: 37979 - RNA, 20 nt, Homo sapiens
uucauuuauuuuauuugcua

SEQ ID NO: 37980 - RNA, 16 nt, Homo sapiens
uuccgaucaagacggu

SEQ ID NO: 37981 - RNA, 17 nt, Homo sapiens
agaaaucuacacuugag

SEQ ID NO: 37982 - RNA, 18 nt, Homo sapiens
uaugccaagaacccaacu

SEQ ID NO: 37983 - RNA, 23 nt, Homo sapiens
uauucggugcguauuuggguaua

SEQ ID NO: 37984 - RNA, 18 nt, Homo sapiens
ucucuuuacugacugggg

SEQ ID NO: 37985 - RNA, 19 nt, Homo sapiens
uuuaaacuuuuugugcaca

SEQ ID NO: 37986 - RNA, 16 nt, Homo sapiens
aacuccuugggugcca

SEQ ID NO: 37987 - RNA, 19 nt, Homo sapiens
aguacuuaugagaaaaaga

SEQ ID NO: 37988 - RNA, 21 nt, Homo sapiens
ccgcgcagcagcgaacggccc

SEQ ID NO: 37989 - RNA, 23 nt, Homo sapiens
cggaggcgggcagaggcggaggc

SEQ ID NO: 37990 - RNA, 20 nt, Homo sapiens
gccagcccgcccgggccgcc

SEQ ID NO: 37991 - RNA, 17 nt, Homo sapiens
gccccggcggccccgcc

SEQ ID NO: 37992 - RNA, 18 nt, Homo sapiens
uacucuaccaaauaucag

SEQ ID NO: 37993 - RNA, 23 nt, Homo sapiens
uaggaugaaaaguggucaaagcu

SEQ ID NO: 37994 - RNA, 19 nt, Homo sapiens
ucaacagggccuucuuauu

SEQ ID NO: 37995 - RNA, 17 nt, Homo sapiens
uccacgggaagagguuu

SEQ ID NO: 37996 - RNA, 27 nt, Homo sapiens
uccccugcccccucccuucccccuggg

SEQ ID NO: 37997 - RNA, 15 nt, Homo sapiens
uggagguuuauuguu

SEQ ID NO: 37998 - RNA, 23 nt, Homo sapiens
ccgcccgggccgccggcagcucc

SEQ ID NO: 37999 - RNA, 17 nt, Homo sapiens
uccacgggaagagguuu

SEQ ID NO: 38000 - RNA, 18 nt, Homo sapiens
ugcccccucccuuccccc

SEQ ID NO: 38001 - RNA, 18 nt, Homo sapiens
cagcccacuccgcggugc

SEQ ID NO: 38002 - RNA, 17 nt, Homo sapiens
gcgucagacgccaggga

SEQ ID NO: 38003 - RNA, 21 nt, Homo sapiens
uguaguaaguaccuggggccu

SEQ ID NO: 38004 - RNA, 24 nt, Homo sapiens
cgcuccggggucggggcgcgcggc

SEQ ID NO: 38005 - RNA, 16 nt, Homo sapiens
cuccgcgucucuccgg

SEQ ID NO: 38006 - RNA, 23 nt, Homo sapiens
gaggcgccuggccggugcgggga

SEQ ID NO: 38007 - RNA, 19 nt, Homo sapiens
gcggccgggaccgggcgcc

SEQ ID NO: 38008 - RNA, 20 nt, Homo sapiens
gcucgcucacugcuggccgg

SEQ ID NO: 38009 - RNA, 19 nt, Homo sapiens
gcugcggggcggcagccgc

SEQ ID NO: 38010 - RNA, 14 nt, Homo sapiens
uccgggcguccgug

SEQ ID NO: 38011 - RNA, 19 nt, Homo sapiens
uuccucauucaaguccucc

SEQ ID NO: 38012 - RNA, 19 nt, Homo sapiens
ccagagccaacugcagucc

SEQ ID NO: 38013 - RNA, 18 nt, Homo sapiens
cugcuuucgaauguaucc

SEQ ID NO: 38014 - RNA, 20 nt, Homo sapiens
gaaaucacccauuuuugccu

SEQ ID NO: 38015 - RNA, 18 nt, Homo sapiens
uggcaugucuggcagugg

SEQ ID NO: 38016 - RNA, 19 nt, Homo sapiens
ugguauagaucacaggguu

SEQ ID NO: 38017 - RNA, 22 nt, Homo sapiens
uccggaacucgauauugaaggu

SEQ ID NO: 38018 - RNA, 16 nt, Homo sapiens
ccccuuuauuuucuug

SEQ ID NO: 38019 - RNA, 22 nt, Homo sapiens
ccccuuuauuuucuugugacuu

SEQ ID NO: 38020 - RNA, 16 nt, Homo sapiens
gcagugugugccaagg

SEQ ID NO: 38021 - RNA, 18 nt, Homo sapiens
ggaugcaggggaacaagu

SEQ ID NO: 38022 - RNA, 17 nt, Homo sapiens
ggccacacccguguggc

SEQ ID NO: 38023 - RNA, 20 nt, Homo sapiens
gggcuacggcuggggcuggg

SEQ ID NO: 38024 - RNA, 20 nt, Homo sapiens
uacacagacucaguagcgga

SEQ ID NO: 38025 - RNA, 17 nt, Homo sapiens
ugugccagcccagagcc

SEQ ID NO: 38026 - RNA, 18 nt, Homo sapiens
uuucucacuucccacaag

SEQ ID NO: 38027 - RNA, 24 nt, Homo sapiens
aacuguacgguggucuugcugagg

SEQ ID NO: 38028 - RNA, 19 nt, Homo sapiens
aaggaaugucacagggccg

SEQ ID NO: 38029 - RNA, 19 nt, Homo sapiens
ccgagccgccagucccugg

SEQ ID NO: 38030 - RNA, 18 nt, Homo sapiens
gaauacugauauuuauac

SEQ ID NO: 38031 - RNA, 20 nt, Homo sapiens
gaggguggccucccggacgc

SEQ ID NO: 38032 - RNA, 18 nt, Homo sapiens
gcgcagggcaagcgcugc

SEQ ID NO: 38033 - RNA, 18 nt, Homo sapiens
gcugcgagcggcccccgc

SEQ ID NO: 38034 - RNA, 16 nt, Homo sapiens
gggcgcuggccggagc

SEQ ID NO: 38035 - RNA, 17 nt, Homo sapiens
ucucacggacaucuucu

SEQ ID NO: 38036 - RNA, 18 nt, Homo sapiens
ugauuuaaaaaaauaccu

SEQ ID NO: 38037 - RNA, 17 nt, Homo sapiens
uggcaauaucaaaggcu

SEQ ID NO: 38038 - RNA, 19 nt, Homo sapiens
ugggcgcuggccggagccc

SEQ ID NO: 38039 - RNA, 20 nt, Homo sapiens
uuguccuuucuaauuuugug

SEQ ID NO: 38040 - RNA, 18 nt, Homo sapiens
aaaggcagauuuaggauc

SEQ ID NO: 38041 - RNA, 18 nt, Homo sapiens
acauuaaaagauuagaag

SEQ ID NO: 38042 - RNA, 18 nt, Homo sapiens
acuagugugaaacaagau

SEQ ID NO: 38043 - RNA, 16 nt, Homo sapiens
aggugagagcuguugc

SEQ ID NO: 38044 - RNA, 17 nt, Homo sapiens
cccggcgcggugggcuc

SEQ ID NO: 38045 - RNA, 20 nt, Homo sapiens
cccgggugucgggcgcggcg

SEQ ID NO: 38046 - RNA, 19 nt, Homo sapiens
cccuacaguuuugcuuuuc

SEQ ID NO: 38047 - RNA, 21 nt, Homo sapiens
cguucgggcccggucccccgc

SEQ ID NO: 38048 - RNA, 17 nt, Homo sapiens
gaggaacauacaucuuu

SEQ ID NO: 38049 - RNA, 19 nt, Homo sapiens
gcacaaugugaccuuagcu

SEQ ID NO: 38050 - RNA, 21 nt, Homo sapiens
ggcgcggcggguggcggcggc

SEQ ID NO: 38051 - RNA, 21 nt, Homo sapiens
ggcgggagaccgcagguguca

SEQ ID NO: 38052 - RNA, 20 nt, Homo sapiens
gggugucgggcgcggcgggu

SEQ ID NO: 38053 - RNA, 17 nt, Homo sapiens
guagaucaacuauuuca

SEQ ID NO: 38054 - RNA, 21 nt, Homo sapiens
uauauuuaggaugcuuucugu

SEQ ID NO: 38055 - RNA, 19 nt, Homo sapiens
cccccgcagcuccggcagc

SEQ ID NO: 38056 - RNA, 17 nt, Homo sapiens
cgccgcgcagcagccgg

SEQ ID NO: 38057 - RNA, 17 nt, Homo sapiens
cuuagguguaggagggg

SEQ ID NO: 38058 - RNA, 22 nt, Homo sapiens
agccgaguggugucccugaggg

SEQ ID NO: 38059 - RNA, 19 nt, Homo sapiens
aggggacuugugguuuggu

SEQ ID NO: 38060 - RNA, 17 nt, Homo sapiens
cagccuccaggagcucc

SEQ ID NO: 38061 - RNA, 18 nt, Homo sapiens
ccagcuccggcuccgcgc

SEQ ID NO: 38062 - RNA, 20 nt, Homo sapiens
cccgccgacucccggcgccc

SEQ ID NO: 38063 - RNA, 17 nt, Homo sapiens
gcgcuccucgccgcccg

SEQ ID NO: 38064 - RNA, 18 nt, Homo sapiens
ggugucccugagggugag

SEQ ID NO: 38065 - RNA, 20 nt, Homo sapiens
guggcgguggcggcggcggc

SEQ ID NO: 38066 - RNA, 20 nt, Homo sapiens
aaaaaaagaaaagaaaaaga

SEQ ID NO: 38067 - RNA, 17 nt, Homo sapiens
ugcagcugcggucugga

SEQ ID NO: 38068 - RNA, 18 nt, Homo sapiens
ugcagcugcggucuggac

SEQ ID NO: 38069 - RNA, 19 nt, Homo sapiens
uuuaaaagaaauucuugca

SEQ ID NO: 38070 - RNA, 23 nt, Homo sapiens
cagcugaugcgggcugccagggc

SEQ ID NO: 38071 - RNA, 16 nt, Homo sapiens
cccgcgcuccaugccc

SEQ ID NO: 38072 - RNA, 18 nt, Homo sapiens
ccgccgcgucuucccgcc

SEQ ID NO: 38073 - RNA, 18 nt, Homo sapiens
ccggagggaacaucaguc

SEQ ID NO: 38074 - RNA, 18 nt, Homo sapiens
ccuugcgccugcuuagcc

SEQ ID NO: 38075 - RNA, 20 nt, Homo sapiens
cugcucuccgccggaucggc

SEQ ID NO: 38076 - RNA, 18 nt, Homo sapiens
gggccgccugcucuggcc

SEQ ID NO: 38077 - RNA, 18 nt, Homo sapiens
gggggcucggacugggcg

SEQ ID NO: 38078 - RNA, 17 nt, Homo sapiens
acaaguuuauucacauu

SEQ ID NO: 38079 - RNA, 20 nt, Homo sapiens
aggccagagggaggggcuug

SEQ ID NO: 38080 - RNA, 22 nt, Homo sapiens
aggccagagggaggggcuuggg

SEQ ID NO: 38081 - RNA, 20 nt, Homo sapiens
ggaaggggaggcacgucucc

SEQ ID NO: 38082 - RNA, 24 nt, Homo sapiens
gggaaggaguggggaaggggaggc

SEQ ID NO: 38083 - RNA, 18 nt, Homo sapiens
cacaccagugcgacuccc

SEQ ID NO: 38084 - RNA, 22 nt, Homo sapiens
cagcugugguggcucacgucug

SEQ ID NO: 38085 - RNA, 19 nt, Homo sapiens
cugccugguuuccugugcu

SEQ ID NO: 38086 - RNA, 20 nt, Homo sapiens
ucgaacuccugacuugugau

SEQ ID NO: 38087 - RNA, 24 nt, Homo sapiens
ucuggcuucugggccggccuggcu

SEQ ID NO: 38088 - RNA, 17 nt, Homo sapiens
aagaagagcaggaagaa

SEQ ID NO: 38089 - RNA, 23 nt, Homo sapiens
aggcauuggugaagggggaggag

SEQ ID NO: 38090 - RNA, 20 nt, Homo sapiens
caugaccagcugaggaacug

SEQ ID NO: 38091 - RNA, 16 nt, Homo sapiens
ccaugauauaacaagu

SEQ ID NO: 38092 - RNA, 20 nt, Homo sapiens
guggagcagagccugugggg

SEQ ID NO: 38093 - RNA, 14 nt, Homo sapiens
uauauggaagagua

SEQ ID NO: 38094 - RNA, 25 nt, Homo sapiens
uguugcuuucuccugaugcccauuc

SEQ ID NO: 38095 - RNA, 21 nt, Homo sapiens
aagguccguuucugacaugcu

SEQ ID NO: 38096 - RNA, 14 nt, Homo sapiens
agagcuaccaaagc

SEQ ID NO: 38097 - RNA, 22 nt, Homo sapiens
agaggucagagagcacacauga

SEQ ID NO: 38098 - RNA, 26 nt, Homo sapiens
cagagagcacacaugaaaucacuggg

SEQ ID NO: 38099 - RNA, 20 nt, Homo sapiens
gaaaguguugcuuggguggu

SEQ ID NO: 38100 - RNA, 24 nt, Homo sapiens
uauauguuaugaauuuucuacaaa

SEQ ID NO: 38101 - RNA, 20 nt, Homo sapiens
ucaguaacucuccuccuuua

SEQ ID NO: 38102 - RNA, 20 nt, Homo sapiens
ucuuuugauuuuccaacacu

SEQ ID NO: 38103 - RNA, 23 nt, Homo sapiens
ugacaaacaaaugugaagacagg

SEQ ID NO: 38104 - RNA, 18 nt, Homo sapiens
ugagaacaacuggccaag

SEQ ID NO: 38105 - RNA, 15 nt, Homo sapiens
ugcugaacaggcuuu

SEQ ID NO: 38106 - RNA, 17 nt, Homo sapiens
uguuucccucuuucucu

SEQ ID NO: 38107 - RNA, 16 nt, Homo sapiens
gaguuugagaccagcc

SEQ ID NO: 38108 - RNA, 26 nt, Homo sapiens
gucagggaugguaccuagagaugccu

SEQ ID NO: 38109 - RNA, 21 nt, Homo sapiens
ucaaaauaaauagaaucauau

SEQ ID NO: 38110 - RNA, 18 nt, Homo sapiens
uuccagauugagugacag

SEQ ID NO: 38111 - RNA, 23 nt, Homo sapiens
agauggaugaugugugguuggag

SEQ ID NO: 38112 - RNA, 15 nt, Homo sapiens
cauacccugcagccc

SEQ ID NO: 38113 - RNA, 18 nt, Homo sapiens
ggaaacaaaauauuugga

SEQ ID NO: 38114 - RNA, 23 nt, Homo sapiens
ucaggaguaaugucuccaagacu

SEQ ID NO: 38115 - RNA, 18 nt, Homo sapiens
ugcccuuguaacccuggc

SEQ ID NO: 38116 - RNA, 20 nt, Homo sapiens
uuuagaaguuggggcucauc

SEQ ID NO: 38117 - RNA, 21 nt, Homo sapiens
uuuucauaugggaaaccccuu

SEQ ID NO: 38118 - RNA, 19 nt, Homo sapiens
caccaaacuccaugggggc

SEQ ID NO: 38119 - RNA, 20 nt, Homo sapiens
ggcuuaauggugccuucccc

SEQ ID NO: 38120 - RNA, 20 nt, Homo sapiens
ucaagggcugucaaagaugg

SEQ ID NO: 38121 - RNA, 18 nt, Homo sapiens
uccaugggggcugaaugc

SEQ ID NO: 38122 - RNA, 23 nt, Homo sapiens
uuugucuuuuuucagauucauuu

SEQ ID NO: 38123 - RNA, 14 nt, Homo sapiens
aacaugauauaggu

SEQ ID NO: 38124 - RNA, 18 nt, Homo sapiens
accaggccccuccuccaa

SEQ ID NO: 38125 - RNA, 17 nt, Homo sapiens
aggguggguggucgggc

SEQ ID NO: 38126 - RNA, 20 nt, Homo sapiens
ugaguacaaacgaauaaagg

SEQ ID NO: 38127 - RNA, 15 nt, Homo sapiens
aguagaaaggagcca

SEQ ID NO: 38128 - RNA, 23 nt, Homo sapiens
uauaauacuucugcacauacaca

SEQ ID NO: 38129 - RNA, 27 nt, Homo sapiens
ugugaaaaauauggaacucaaguaaga

SEQ ID NO: 38130 - RNA, 22 nt, Homo sapiens
accauaaaugaauuuuguuuua

SEQ ID NO: 38131 - RNA, 18 nt, Homo sapiens
aggaccaaagaggaaaca

SEQ ID NO: 38132 - RNA, 15 nt, Homo sapiens
aggggccaguuugga

SEQ ID NO: 38133 - RNA, 16 nt, Homo sapiens
aguacuugcauauaac

SEQ ID NO: 38134 - RNA, 19 nt, Homo sapiens
ucgccacccaccccacuac

SEQ ID NO: 38135 - RNA, 19 nt, Homo sapiens
uguugauaguuuuaauuca

SEQ ID NO: 38136 - RNA, 19 nt, Homo sapiens
uguuuuauuaagucaggcu

SEQ ID NO: 38137 - RNA, 19 nt, Homo sapiens
agcaagggccuucugcguu

SEQ ID NO: 38138 - RNA, 17 nt, Homo sapiens
uacacaccaggggcaca

SEQ ID NO: 38139 - RNA, 17 nt, Homo sapiens
ucgcuugcuugcuugcu

SEQ ID NO: 38140 - RNA, 15 nt, Homo sapiens
ucugugcaguaacag

SEQ ID NO: 38141 - RNA, 19 nt, Homo sapiens
ggaaaggcuccacggggca

SEQ ID NO: 38142 - RNA, 19 nt, Homo sapiens
uaucggggccccggagccg

SEQ ID NO: 38143 - RNA, 18 nt, Homo sapiens
ugggaaggagaaggagaa

SEQ ID NO: 38144 - RNA, 21 nt, Homo sapiens
cguuaccccuggcaacguaca

SEQ ID NO: 38145 - RNA, 22 nt, Homo sapiens
acgcuuauuucuggguguccaa

SEQ ID NO: 38146 - RNA, 16 nt, Homo sapiens
cagagccacggccucc

SEQ ID NO: 38147 - RNA, 19 nt, Homo sapiens
cagcaguucaggggcucgg

SEQ ID NO: 38148 - RNA, 18 nt, Homo sapiens
ccaggccaggcugggggc

SEQ ID NO: 38149 - RNA, 18 nt, Homo sapiens
gcuggauccucugcuugu

SEQ ID NO: 38150 - RNA, 15 nt, Homo sapiens
ggccaguaugcagcc

SEQ ID NO: 38151 - RNA, 18 nt, Homo sapiens
gguuguuguagggcugcu

SEQ ID NO: 38152 - RNA, 18 nt, Homo sapiens
ucggagguggcuggggcg

SEQ ID NO: 38153 - RNA, 18 nt, Homo sapiens
ucugggggcagcaguggg

SEQ ID NO: 38154 - RNA, 22 nt, Homo sapiens
ccuacccgccucagcgucuguc

SEQ ID NO: 38155 - RNA, 21 nt, Homo sapiens
aaaacuccaagaagacagaga

SEQ ID NO: 38156 - RNA, 20 nt, Homo sapiens
gcaggaaugagccagugcag

SEQ ID NO: 38157 - RNA, 23 nt, Homo sapiens
gcugacaccugaauguugagaag

SEQ ID NO: 38158 - RNA, 20 nt, Homo sapiens
ggcaggcugaguaaaugggg

SEQ ID NO: 38159 - RNA, 17 nt, Homo sapiens
uggagccuggugaaugg

SEQ ID NO: 38160 - RNA, 18 nt, Homo sapiens
aagggaggggggggcggg

SEQ ID NO: 38161 - RNA, 16 nt, Homo sapiens
agaugguuauguuggg

SEQ ID NO: 38162 - RNA, 18 nt, Homo sapiens
guugggauaccuaauguc

SEQ ID NO: 38163 - RNA, 22 nt, Homo sapiens
uuacauacagugguuaacauac

SEQ ID NO: 38164 - RNA, 25 nt, Homo sapiens
aaagaaaguuaaaaauuccuaaaga

SEQ ID NO: 38165 - RNA, 17 nt, Homo sapiens
ggguuggacucaggcgu

SEQ ID NO: 38166 - RNA, 23 nt, Homo sapiens
gugcguuaaugugacuaaacaag

SEQ ID NO: 38167 - RNA, 19 nt, Homo sapiens
ugauggcauaauaaaccaa

SEQ ID NO: 38168 - RNA, 17 nt, Homo sapiens
ugggacaggaaaggcgu

SEQ ID NO: 38169 - RNA, 17 nt, Homo sapiens
uuggaauguuacacaca

SEQ ID NO: 38170 - RNA, 18 nt, Homo sapiens
accgucuucucuguuguu

SEQ ID NO: 38171 - RNA, 19 nt, Homo sapiens
acacugugagccuggggaa

SEQ ID NO: 38172 - RNA, 19 nt, Homo sapiens
agaggaauuagugggagcc

SEQ ID NO: 38173 - RNA, 17 nt, Homo sapiens
agcuggcugucaacaga

SEQ ID NO: 38174 - RNA, 20 nt, Homo sapiens
caaaacaguugugaugggcu

SEQ ID NO: 38175 - RNA, 16 nt, Homo sapiens
ccaagacaaugaucuc

SEQ ID NO: 38176 - RNA, 17 nt, Homo sapiens
cccugcuuaugaggaac

SEQ ID NO: 38177 - RNA, 23 nt, Homo sapiens
cccugggugaugaagcccagugu

SEQ ID NO: 38178 - RNA, 19 nt, Homo sapiens
cgccacgacccucagggac

SEQ ID NO: 38179 - RNA, 19 nt, Homo sapiens
gaccauugucucucagcuc

SEQ ID NO: 38180 - RNA, 20 nt, Homo sapiens
gagaaggcuaggguuggagg

SEQ ID NO: 38181 - RNA, 15 nt, Homo sapiens
gaguucucagaugag

SEQ ID NO: 38182 - RNA, 17 nt, Homo sapiens
gaguuucuuaccacacc

SEQ ID NO: 38183 - RNA, 23 nt, Homo sapiens
gcccccuggcuuucccauucucc

SEQ ID NO: 38184 - RNA, 16 nt, Homo sapiens
ggcaggguuggggaga

SEQ ID NO: 38185 - RNA, 19 nt, Homo sapiens
ggggagaggcugggggguu

SEQ ID NO: 38186 - RNA, 19 nt, Homo sapiens
ggguuggggagaggcuggg

SEQ ID NO: 38187 - RNA, 20 nt, Homo sapiens
gguggaguagaggcaggaag

SEQ ID NO: 38188 - RNA, 17 nt, Homo sapiens
gugggagccugggggaa

SEQ ID NO: 38189 - RNA, 21 nt, Homo sapiens
guguugcagaucugauguauu

SEQ ID NO: 38190 - RNA, 20 nt, Homo sapiens
uacuggcauugccaaccaau

SEQ ID NO: 38191 - RNA, 20 nt, Homo sapiens
uagaacacuccauucccaca

SEQ ID NO: 38192 - RNA, 21 nt, Homo sapiens
ucccuccugauguuucuuucc

SEQ ID NO: 38193 - RNA, 22 nt, Homo sapiens
ucucaacuuugguaaaagagag

SEQ ID NO: 38194 - RNA, 19 nt, Homo sapiens
ugguauuuugggaagauca

SEQ ID NO: 38195 - RNA, 21 nt, Homo sapiens
uuacaaugagguuacccaugg

SEQ ID NO: 38196 - RNA, 20 nt, Homo sapiens
uuccaggguugucauuguac

SEQ ID NO: 38197 - RNA, 18 nt, Homo sapiens
uuggggagaggcuggggg

SEQ ID NO: 38198 - RNA, 15 nt, Homo sapiens
caggaaguguuucug

SEQ ID NO: 38199 - RNA, 21 nt, Homo sapiens
gcgccuggcccgagaguuguc

SEQ ID NO: 38200 - RNA, 21 nt, Homo sapiens
caccccaccuccacugccacc

SEQ ID NO: 38201 - RNA, 16 nt, Homo sapiens
cccgccgcccagaccc

SEQ ID NO: 38202 - RNA, 23 nt, Homo sapiens
ccucacaccuccucccgccuguc

SEQ ID NO: 38203 - RNA, 23 nt, Homo sapiens
ccucgcgcucuucugccccucgc

SEQ ID NO: 38204 - RNA, 19 nt, Homo sapiens
cgguggcgcccgccugccu

SEQ ID NO: 38205 - RNA, 16 nt, Homo sapiens
gagcuggcugcagggc

SEQ ID NO: 38206 - RNA, 21 nt, Homo sapiens
gagggcuguggguccuggcug

SEQ ID NO: 38207 - RNA, 20 nt, Homo sapiens
gagggguggggcgggguggg

SEQ ID NO: 38208 - RNA, 18 nt, Homo sapiens
gcccgccugccuggcgcc

SEQ ID NO: 38209 - RNA, 17 nt, Homo sapiens
gcgccgcggugcaacca

SEQ ID NO: 38210 - RNA, 18 nt, Homo sapiens
gcggacucugcugcucgc

SEQ ID NO: 38211 - RNA, 20 nt, Homo sapiens
ggaagucaacgguagcagcg

SEQ ID NO: 38212 - RNA, 15 nt, Homo sapiens
ggaugguuugucacu

SEQ ID NO: 38213 - RNA, 20 nt, Homo sapiens
ggcugcagggccguugggua

SEQ ID NO: 38214 - RNA, 18 nt, Homo sapiens
gggcagcuggggagggcu

SEQ ID NO: 38215 - RNA, 18 nt, Homo sapiens
ggggccggcuccgcccuc

SEQ ID NO: 38216 - RNA, 20 nt, Homo sapiens
ggggcucuuccugggcagcu

SEQ ID NO: 38217 - RNA, 23 nt, Homo sapiens
guagcuguggguugaaccuggac

SEQ ID NO: 38218 - RNA, 17 nt, Homo sapiens
guggcgguggcgcccgc

SEQ ID NO: 38219 - RNA, 16 nt, Homo sapiens
gugggaucgcgcccgc

SEQ ID NO: 38220 - RNA, 21 nt, Homo sapiens
guguguguguguguguguauc

SEQ ID NO: 38221 - RNA, 17 nt, Homo sapiens
uagaauaugaagaagaa

SEQ ID NO: 38222 - RNA, 19 nt, Homo sapiens
ucacuggaugguuuguugg

SEQ ID NO: 38223 - RNA, 19 nt, Homo sapiens
uccaaucagaugacucugg

SEQ ID NO: 38224 - RNA, 18 nt, Homo sapiens
uccggagaggagggacug

SEQ ID NO: 38225 - RNA, 18 nt, Homo sapiens
ugcacagacccagccgcc

SEQ ID NO: 38226 - RNA, 19 nt, Homo sapiens
ugccuauucuuacaacaga

SEQ ID NO: 38227 - RNA, 18 nt, Homo sapiens
ugugugugugugugugug

SEQ ID NO: 38228 - RNA, 20 nt, Homo sapiens
ugugugugugugugugugua

SEQ ID NO: 38229 - RNA, 17 nt, Homo sapiens
uuaaaaauaaacuguau

SEQ ID NO: 38230 - RNA, 22 nt, Homo sapiens
uuggaauagagcaguaaucaca

SEQ ID NO: 38231 - RNA, 23 nt, Homo sapiens
uuugugugugugugugugugugu

SEQ ID NO: 38232 - RNA, 22 nt, Homo sapiens
ccugcugcuccuggguaucauu

SEQ ID NO: 38233 - RNA, 21 nt, Homo sapiens
uaaagccugcugcuccugggu

SEQ ID NO: 38234 - RNA, 18 nt, Homo sapiens
aagcagaguggcugucug

SEQ ID NO: 38235 - RNA, 16 nt, Homo sapiens
agucaauggcuagaug

SEQ ID NO: 38236 - RNA, 18 nt, Homo sapiens
caacagccagccccucug

SEQ ID NO: 38237 - RNA, 24 nt, Homo sapiens
ccagguagccauugaccagggcuu

SEQ ID NO: 38238 - RNA, 15 nt, Homo sapiens
cccggcugggauucc

SEQ ID NO: 38239 - RNA, 20 nt, Homo sapiens
ccggcugggauuccuucuuc

SEQ ID NO: 38240 - RNA, 19 nt, Homo sapiens
cgcucuccaccucuccucc

SEQ ID NO: 38241 - RNA, 18 nt, Homo sapiens
cucuggucucugaucucc

SEQ ID NO: 38242 - RNA, 21 nt, Homo sapiens
cuggugccuuggccguuccuu

SEQ ID NO: 38243 - RNA, 16 nt, Homo sapiens
cuucuugauucuuccu

SEQ ID NO: 38244 - RNA, 17 nt, Homo sapiens
gacaccacaccgugccc

SEQ ID NO: 38245 - RNA, 19 nt, Homo sapiens
gagauuggggaaaguaagg

SEQ ID NO: 38246 - RNA, 24 nt, Homo sapiens
gcccugggccuuggagccugaaag

SEQ ID NO: 38247 - RNA, 16 nt, Homo sapiens
gcgaaggggaggggaa

SEQ ID NO: 38248 - RNA, 17 nt, Homo sapiens
gcgugguggcaggcgcc

SEQ ID NO: 38249 - RNA, 22 nt, Homo sapiens
gcuagcucggggcugagucucc

SEQ ID NO: 38250 - RNA, 19 nt, Homo sapiens
ggcagcggggcucauggga

SEQ ID NO: 38251 - RNA, 15 nt, Homo sapiens
ggccugcagcugccc

SEQ ID NO: 38252 - RNA, 22 nt, Homo sapiens
gggaaaguaaggggggcgaagg

SEQ ID NO: 38253 - RNA, 19 nt, Homo sapiens
gggaagaagguggaacaca

SEQ ID NO: 38254 - RNA, 18 nt, Homo sapiens
ggugagaggaugggaggg

SEQ ID NO: 38255 - RNA, 14 nt, Homo sapiens
gucaggacuccuac

SEQ ID NO: 38256 - RNA, 19 nt, Homo sapiens
uccucacccgcccccgccu

SEQ ID NO: 38257 - RNA, 15 nt, Homo sapiens
uccuccacuccaccc

SEQ ID NO: 38258 - RNA, 16 nt, Homo sapiens
ucuuggccuuucccag

SEQ ID NO: 38259 - RNA, 17 nt, Homo sapiens
ugggcugugggguggga

SEQ ID NO: 38260 - RNA, 17 nt, Homo sapiens
uugggaggccgaggugg

SEQ ID NO: 38261 - RNA, 19 nt, Homo sapiens
uuucacacacucuccaucu

SEQ ID NO: 38262 - RNA, 23 nt, Homo sapiens
uuugucuuuuucuuuauccaagu

SEQ ID NO: 38263 - RNA, 16 nt, Homo sapiens
cgggcucgggcagcgg

SEQ ID NO: 38264 - RNA, 21 nt, Homo sapiens
cacagugugggggccgccugc

SEQ ID NO: 38265 - RNA, 18 nt, Homo sapiens
ccgggggguggcugcugc

SEQ ID NO: 38266 - RNA, 19 nt, Homo sapiens
ccuggugccugugucucug

SEQ ID NO: 38267 - RNA, 15 nt, Homo sapiens
gcauuccaguguucg

SEQ ID NO: 38268 - RNA, 14 nt, Homo sapiens
gcugcucaaggaca

SEQ ID NO: 38269 - RNA, 16 nt, Homo sapiens
ggagaccugugcugcg

SEQ ID NO: 38270 - RNA, 19 nt, Homo sapiens
ggccccgggggguggcugc

SEQ ID NO: 38271 - RNA, 15 nt, Homo sapiens
gggggccgccugccu

SEQ ID NO: 38272 - RNA, 20 nt, Homo sapiens
aaacuugagacucauaaaug

SEQ ID NO: 38273 - RNA, 27 nt, Homo sapiens
aaggauuugucaugauggcuguauaca

SEQ ID NO: 38274 - RNA, 18 nt, Homo sapiens
aaggggcugagggaggaa

SEQ ID NO: 38275 - RNA, 19 nt, Homo sapiens
accuaccacuugugcuguu

SEQ ID NO: 38276 - RNA, 18 nt, Homo sapiens
ccauauggacucaugugc

SEQ ID NO: 38277 - RNA, 19 nt, Homo sapiens
cgggcggcgcgacgggcgg

SEQ ID NO: 38278 - RNA, 18 nt, Homo sapiens
gagcaaaggcagugaagg

SEQ ID NO: 38279 - RNA, 18 nt, Homo sapiens
gcccagggacagauaccu

SEQ ID NO: 38280 - RNA, 18 nt, Homo sapiens
gcugggggaagggugcag

SEQ ID NO: 38281 - RNA, 17 nt, Homo sapiens
ggcgggcggcgcgacgg

SEQ ID NO: 38282 - RNA, 17 nt, Homo sapiens
uaacacugaaaggauac

SEQ ID NO: 38283 - RNA, 21 nt, Homo sapiens
ucucucaacuuggagaguaau

SEQ ID NO: 38284 - RNA, 21 nt, Homo sapiens
ugaaaggauacucaauacaga

SEQ ID NO: 38285 - RNA, 19 nt, Homo sapiens
ugcagggggaaaaauagcc

SEQ ID NO: 38286 - RNA, 22 nt, Homo sapiens
ugggugggaaugguggaggcaa

SEQ ID NO: 38287 - RNA, 18 nt, Homo sapiens
acaccacgaaaagauguc

SEQ ID NO: 38288 - RNA, 16 nt, Homo sapiens
cggcuccggcucuggc

SEQ ID NO: 38289 - RNA, 24 nt, Homo sapiens
gccacggcuccggcucugcggggc

SEQ ID NO: 38290 - RNA, 14 nt, Homo sapiens
uaguauucauugcu

SEQ ID NO: 38291 - RNA, 19 nt, Homo sapiens
aggcugcaguccaccaggg

SEQ ID NO: 38292 - RNA, 19 nt, Homo sapiens
aggggccggagggggggac

SEQ ID NO: 38293 - RNA, 19 nt, Homo sapiens
aggggucaggaacccuggg

SEQ ID NO: 38294 - RNA, 21 nt, Homo sapiens
cagugucccagcagccccugc

SEQ ID NO: 38295 - RNA, 19 nt, Homo sapiens
cauccaggguguaagaggu

SEQ ID NO: 38296 - RNA, 16 nt, Homo sapiens
cccaccacccaccgcc

SEQ ID NO: 38297 - RNA, 17 nt, Homo sapiens
ccucccgcccugcauca

SEQ ID NO: 38298 - RNA, 16 nt, Homo sapiens
gcccgugggcugcucu

SEQ ID NO: 38299 - RNA, 19 nt, Homo sapiens
gcggggagcucuggggagg

SEQ ID NO: 38300 - RNA, 19 nt, Homo sapiens
ggagaggggcggccacggg

SEQ ID NO: 38301 - RNA, 22 nt, Homo sapiens
ggagaggggcggccacgggcgg

SEQ ID NO: 38302 - RNA, 17 nt, Homo sapiens
ggggaggugcgcuggag

SEQ ID NO: 38303 - RNA, 20 nt, Homo sapiens
gggucugaggaggaggcucc

SEQ ID NO: 38304 - RNA, 24 nt, Homo sapiens
ucaccaccugugcccaccuccucc

SEQ ID NO: 38305 - RNA, 18 nt, Homo sapiens
ugcccaccacccaccgcc

SEQ ID NO: 38306 - RNA, 20 nt, Homo sapiens
uggccucacuccuguguggu

SEQ ID NO: 38307 - RNA, 18 nt, Homo sapiens
aagaggccaccggggcuc

SEQ ID NO: 38308 - RNA, 20 nt, Homo sapiens
acacggugggggugagaacu

SEQ ID NO: 38309 - RNA, 19 nt, Homo sapiens
accaaaacaaaacaaaaaa

SEQ ID NO: 38310 - RNA, 18 nt, Homo sapiens
agggaacaaaauacgaug

SEQ ID NO: 38311 - RNA, 21 nt, Homo sapiens
aggugauuuuauucuuccauu

SEQ ID NO: 38312 - RNA, 21 nt, Homo sapiens
auucucaauuaccuguaccgc

SEQ ID NO: 38313 - RNA, 27 nt, Homo sapiens
cacccgccuccugcauguguggaguag

SEQ ID NO: 38314 - RNA, 17 nt, Homo sapiens
cgggcgcggcggcggcg

SEQ ID NO: 38315 - RNA, 21 nt, Homo sapiens
cugacagccacagcccaugua

SEQ ID NO: 38316 - RNA, 20 nt, Homo sapiens
gaggcagcugugucuuuugg

SEQ ID NO: 38317 - RNA, 19 nt, Homo sapiens
gauuacagguaugugcuac

SEQ ID NO: 38318 - RNA, 19 nt, Homo sapiens
gcggaagggaaauuuaaga

SEQ ID NO: 38319 - RNA, 17 nt, Homo sapiens
ggcgacgggggcgacgg

SEQ ID NO: 38320 - RNA, 18 nt, Homo sapiens
ggcgaggggcgacggggg

SEQ ID NO: 38321 - RNA, 16 nt, Homo sapiens
ggcgcggcggcggcgg

SEQ ID NO: 38322 - RNA, 20 nt, Homo sapiens
gggaggcgaggggcgacggg

SEQ ID NO: 38323 - RNA, 23 nt, Homo sapiens
gggaggcgaggggcgacgggggc

SEQ ID NO: 38324 - RNA, 19 nt, Homo sapiens
guccaggggaggaggacac

SEQ ID NO: 38325 - RNA, 22 nt, Homo sapiens
uagaugguuucgaacuccgugg

SEQ ID NO: 38326 - RNA, 19 nt, Homo sapiens
uauuccuacuccagugacc

SEQ ID NO: 38327 - RNA, 24 nt, Homo sapiens
uccuuggccucccaaaguguuggg

SEQ ID NO: 38328 - RNA, 23 nt, Homo sapiens
ugggagggaaguaccguaguaca

SEQ ID NO: 38329 - RNA, 19 nt, Homo sapiens
uguugauucuuaagagcga

SEQ ID NO: 38330 - RNA, 23 nt, Homo sapiens
aucuccagccaccaccuugaguu

SEQ ID NO: 38331 - RNA, 20 nt, Homo sapiens
aucuccagccaccuugaguu

SEQ ID NO: 38332 - RNA, 20 nt, Homo sapiens
ccccagccccgccgucgcuc

SEQ ID NO: 38333 - RNA, 17 nt, Homo sapiens
gggucccugcugcugcc

SEQ ID NO: 38334 - RNA, 25 nt, Homo sapiens
ugggagggaugacaccgggguggcg

SEQ ID NO: 38335 - RNA, 21 nt, Homo sapiens
uucaugucugagcaccuugug

SEQ ID NO: 38336 - RNA, 18 nt, Homo sapiens
gcagcacagccggcgcgg

SEQ ID NO: 38337 - RNA, 14 nt, Homo sapiens
ggguggggaaggga

SEQ ID NO: 38338 - RNA, 20 nt, Homo sapiens
uaucacaguaacaagaucau

SEQ ID NO: 38339 - RNA, 19 nt, Homo sapiens
uccccucuucccgcucgcg

SEQ ID NO: 38340 - RNA, 24 nt, Homo sapiens
uggcugcauaugcuuuccuauuga

SEQ ID NO: 38341 - RNA, 18 nt, Homo sapiens
ugggugacuuuccuacuu

SEQ ID NO: 38342 - RNA, 14 nt, Homo sapiens
uguuugggugacuu

SEQ ID NO: 38343 - RNA, 18 nt, Homo sapiens
cccagcuaaguuguccgg

SEQ ID NO: 38344 - RNA, 20 nt, Homo sapiens
gaggcccagccaggccgggc

SEQ ID NO: 38345 - RNA, 18 nt, Homo sapiens
gccugcgccggcuggagc

SEQ ID NO: 38346 - RNA, 22 nt, Homo sapiens
ugcaagagaggcccagccaggc

SEQ ID NO: 38347 - RNA, 22 nt, Homo sapiens
uuggccccucauggggagggau

SEQ ID NO: 38348 - RNA, 21 nt, Homo sapiens
aagcuuuucagcugcuggguu

SEQ ID NO: 38349 - RNA, 15 nt, Homo sapiens
aaggugugaaaagga

SEQ ID NO: 38350 - RNA, 20 nt, Homo sapiens
acagguaugcgccaccaugc

SEQ ID NO: 38351 - RNA, 17 nt, Homo sapiens
cagcagcuucugauguu

SEQ ID NO: 38352 - RNA, 18 nt, Homo sapiens
cagcaugacugugaagga

SEQ ID NO: 38353 - RNA, 18 nt, Homo sapiens
caucacaguuguuuuuuu

SEQ ID NO: 38354 - RNA, 20 nt, Homo sapiens
ccaaaauucucuuuuccuuc

SEQ ID NO: 38355 - RNA, 15 nt, Homo sapiens
ccccaaguccucucu

SEQ ID NO: 38356 - RNA, 19 nt, Homo sapiens
ccugguccugacauuugcc

SEQ ID NO: 38357 - RNA, 20 nt, Homo sapiens
gagggcacugggaaugccag

SEQ ID NO: 38358 - RNA, 19 nt, Homo sapiens
gauuacagguaugcgccac

SEQ ID NO: 38359 - RNA, 16 nt, Homo sapiens
gggcagggggaauaga

SEQ ID NO: 38360 - RNA, 22 nt, Homo sapiens
uacugucuuaguaaauguuuaa

SEQ ID NO: 38361 - RNA, 19 nt, Homo sapiens
ucugcuucacucuuuaauu

SEQ ID NO: 38362 - RNA, 19 nt, Homo sapiens
ugcaacaggucauguucaa

SEQ ID NO: 38363 - RNA, 19 nt, Homo sapiens
uguuuuugucacccucgcu

SEQ ID NO: 38364 - RNA, 19 nt, Homo sapiens
uucacguuuguuaauaaac

SEQ ID NO: 38365 - RNA, 18 nt, Homo sapiens
uuguaaugauaccaugau

SEQ ID NO: 38366 - RNA, 23 nt, Homo sapiens
uuuacaugcacaguucauugcca

SEQ ID NO: 38367 - RNA, 21 nt, Homo sapiens
uuucucaacugugaacaccuu

SEQ ID NO: 38368 - RNA, 25 nt, Homo sapiens
augagcucaugaacucacucuucaa

SEQ ID NO: 38369 - RNA, 18 nt, Homo sapiens
ccuccguccuccagguuc

SEQ ID NO: 38370 - RNA, 23 nt, Homo sapiens
cuuuguacuguggggugaaccgc

SEQ ID NO: 38371 - RNA, 17 nt, Homo sapiens
gcccuuggagcgagcag

SEQ ID NO: 38372 - RNA, 18 nt, Homo sapiens
ggugcagagcaggugaga

SEQ ID NO: 38373 - RNA, 20 nt, Homo sapiens
ucagagcuuccuccaagauc

SEQ ID NO: 38374 - RNA, 17 nt, Homo sapiens
uccagcugcacgccugc

SEQ ID NO: 38375 - RNA, 18 nt, Homo sapiens
ucugccauauauagagau

SEQ ID NO: 38376 - RNA, 18 nt, Homo sapiens
ugccauauggccaccgcc

SEQ ID NO: 38377 - RNA, 16 nt, Homo sapiens
ugcccuuggagcgagc

SEQ ID NO: 38378 - RNA, 18 nt, Homo sapiens
ugcuguucaccagagccc

SEQ ID NO: 38379 - RNA, 18 nt, Homo sapiens
uggugguggggggucccu

SEQ ID NO: 38380 - RNA, 18 nt, Homo sapiens
uuccucauuuuaagagau

SEQ ID NO: 38381 - RNA, 20 nt, Homo sapiens
agcggaggggaggcgcugga

SEQ ID NO: 38382 - RNA, 21 nt, Homo sapiens
aggccacaccuggacaaucac

SEQ ID NO: 38383 - RNA, 18 nt, Homo sapiens
ugcgaugcugaugcgugc

SEQ ID NO: 38384 - RNA, 18 nt, Homo sapiens
uggcugcgaugcugaugc

SEQ ID NO: 38385 - RNA, 22 nt, Homo sapiens
acagcagccagggacccgcccc

SEQ ID NO: 38386 - RNA, 24 nt, Homo sapiens
agaagguggugggguaugcuggag

SEQ ID NO: 38387 - RNA, 18 nt, Homo sapiens
agcagccagggacccgcc

SEQ ID NO: 38388 - RNA, 25 nt, Homo sapiens
agcggggggagggggucaggggagg

SEQ ID NO: 38389 - RNA, 21 nt, Homo sapiens
aggccgggccacgccgcccuc

SEQ ID NO: 38390 - RNA, 17 nt, Homo sapiens
cagcggggggagggggu

SEQ ID NO: 38391 - RNA, 23 nt, Homo sapiens
cugccgccucugcgcaggcgcgu

SEQ ID NO: 38392 - RNA, 19 nt, Homo sapiens
cagcgucucaagagccccg

SEQ ID NO: 38393 - RNA, 25 nt, Homo sapiens
gagggcauucaccgggugggugagc

SEQ ID NO: 38394 - RNA, 17 nt, Homo sapiens
gcuccccucccuucccc

SEQ ID NO: 38395 - RNA, 21 nt, Homo sapiens
ggguggcaccacgcgcucagc

SEQ ID NO: 38396 - RNA, 23 nt, Homo sapiens
aagugcacuuuuagaacaauagg

SEQ ID NO: 38397 - RNA, 15 nt, Homo sapiens
cuaauuauucaccca

SEQ ID NO: 38398 - RNA, 18 nt, Homo sapiens
cugcucuuugcugggcug

SEQ ID NO: 38399 - RNA, 21 nt, Homo sapiens
gagauagucuuaugagaacua

SEQ ID NO: 38400 - RNA, 24 nt, Homo sapiens
uaucacaaauggaacauguaauau

SEQ ID NO: 38401 - RNA, 18 nt, Homo sapiens
ugugcauauagagcuuug

SEQ ID NO: 38402 - RNA, 19 nt, Homo sapiens
aggcggcggugggggaggg

SEQ ID NO: 38403 - RNA, 22 nt, Homo sapiens
aggugugcugagcuccgaggcg

SEQ ID NO: 38404 - RNA, 19 nt, Homo sapiens
cagaggcggcgcgguggcg

SEQ ID NO: 38405 - RNA, 22 nt, Homo sapiens
cccaaaguucaucuuuaauugc

SEQ ID NO: 38406 - RNA, 16 nt, Homo sapiens
cccuggcuccuccccc

SEQ ID NO: 38407 - RNA, 18 nt, Homo sapiens
gagcgcgccuccuggggu

SEQ ID NO: 38408 - RNA, 18 nt, Homo sapiens
cagaaucuccagggcucu

SEQ ID NO: 38409 - RNA, 17 nt, Homo sapiens
cagccgccaggccuucc

SEQ ID NO: 38410 - RNA, 19 nt, Homo sapiens
caucugucuuuaguuacuu

SEQ ID NO: 38411 - RNA, 22 nt, Homo sapiens
ccagcgaaggaaggcgcgcccg

SEQ ID NO: 38412 - RNA, 27 nt, Homo sapiens
ccccggaagcccaagggccgagguccu

SEQ ID NO: 38413 - RNA, 23 nt, Homo sapiens
ccgcucagccgccaggccuuccg

SEQ ID NO: 38414 - RNA, 19 nt, Homo sapiens
ccgcucuagggcggucccc

SEQ ID NO: 38415 - RNA, 21 nt, Homo sapiens
ccuccggcgcucagcccucgu

SEQ ID NO: 38416 - RNA, 16 nt, Homo sapiens
cgagucauuuucccuu

SEQ ID NO: 38417 - RNA, 20 nt, Homo sapiens
cugguggccuaaccaggacc

SEQ ID NO: 38418 - RNA, 20 nt, Homo sapiens
cuuuggggagaagggagggg

SEQ ID NO: 38419 - RNA, 28 nt, Homo sapiens
gagcaguccauuuuuguggccgcgaccg

SEQ ID NO: 38420 - RNA, 17 nt, Homo sapiens
gcuuuuauuauguauuc

SEQ ID NO: 38421 - RNA, 23 nt, Homo sapiens
ggaggcggcgaaggcgccugcgg

SEQ ID NO: 38422 - RNA, 20 nt, Homo sapiens
gggagggaggcggcgaaggc

SEQ ID NO: 38423 - RNA, 22 nt, Homo sapiens
guaaggaaaucggcucucuggu

SEQ ID NO: 38424 - RNA, 19 nt, Homo sapiens
gucuucucaucccuuugcc

SEQ ID NO: 38425 - RNA, 18 nt, Homo sapiens
uaaguuggaguguucugu

SEQ ID NO: 38426 - RNA, 18 nt, Homo sapiens
ucccgcgggagagccucu

SEQ ID NO: 38427 - RNA, 17 nt, Homo sapiens
ucccggguggacagguc

SEQ ID NO: 38428 - RNA, 22 nt, Homo sapiens
ugacggucuaaagggucaaauu

SEQ ID NO: 38429 - RNA, 20 nt, Homo sapiens
ugccuugacaucugcaugcu

SEQ ID NO: 38430 - RNA, 20 nt, Homo sapiens
ugucaugggcauuguauuac

SEQ ID NO: 38431 - RNA, 16 nt, Homo sapiens
uuugcuaggaucugug

SEQ ID NO: 38432 - RNA, 20 nt, Homo sapiens
guagccgugacauuugcauu

SEQ ID NO: 38433 - RNA, 20 nt, Homo sapiens
uguguauuucuuuaccauuc

SEQ ID NO: 38434 - RNA, 18 nt, Homo sapiens
aggcggccggguccugcg

SEQ ID NO: 38435 - RNA, 20 nt, Homo sapiens
augaccaggguucuuauaaa

SEQ ID NO: 38436 - RNA, 18 nt, Homo sapiens
ccgaggaggcuccgcucc

SEQ ID NO: 38437 - RNA, 21 nt, Homo sapiens
ccuggucccgaggaggcuccg

SEQ ID NO: 38438 - RNA, 19 nt, Homo sapiens
cgccgccaggccacggugc

SEQ ID NO: 38439 - RNA, 23 nt, Homo sapiens
cggccuagagcuccuccucgggc

SEQ ID NO: 38440 - RNA, 21 nt, Homo sapiens
gaaugguccuggggaaggugg

SEQ ID NO: 38441 - RNA, 22 nt, Homo sapiens
gcagguggagcggguguguggc

SEQ ID NO: 38442 - RNA, 19 nt, Homo sapiens
gcccgggcuuuagcagagg

SEQ ID NO: 38443 - RNA, 23 nt, Homo sapiens
ggagggcccagcccggcugggcg

SEQ ID NO: 38444 - RNA, 18 nt, Homo sapiens
gggagggcccagcccggc

SEQ ID NO: 38445 - RNA, 25 nt, Homo sapiens
gggccuggggagaccuggggcuggg

SEQ ID NO: 38446 - RNA, 19 nt, Homo sapiens
gggcgucguccgagugagc

SEQ ID NO: 38447 - RNA, 18 nt, Homo sapiens
gggcugggcgggggccgg

SEQ ID NO: 38448 - RNA, 22 nt, Homo sapiens
gugaccgggggcucgccgccag

SEQ ID NO: 38449 - RNA, 20 nt, Homo sapiens
ugagagccagccugucgggg

SEQ ID NO: 38450 - RNA, 18 nt, Homo sapiens
ugcccgggcuuuagcaga

SEQ ID NO: 38451 - RNA, 19 nt, Homo sapiens
uggcaggaggcgugggggc

SEQ ID NO: 38452 - RNA, 17 nt, Homo sapiens
uugggggacaccacgga

SEQ ID NO: 38453 - RNA, 19 nt, Homo sapiens
ccaaucaacuuucucuucu

SEQ ID NO: 38454 - RNA, 18 nt, Homo sapiens
ggcggugagucagccaag

SEQ ID NO: 38455 - RNA, 23 nt, Homo sapiens
guuguucuuucaaaaaagaagaa

SEQ ID NO: 38456 - RNA, 20 nt, Homo sapiens
auacagauauauauauauau

SEQ ID NO: 38457 - RNA, 22 nt, Homo sapiens
auauauauauuuacauauauau

SEQ ID NO: 38458 - RNA, 23 nt, Homo sapiens
cucacugagucuuuucugagcaa

SEQ ID NO: 38459 - RNA, 18 nt, Homo sapiens
cugcguguugcucacuca

SEQ ID NO: 38460 - RNA, 24 nt, Homo sapiens
uauauauauauuuacauauauaua

SEQ ID NO: 38461 - RNA, 21 nt, Homo sapiens
ucaaagccuggagauguuuuu

SEQ ID NO: 38462 - RNA, 21 nt, Homo sapiens
ucauggaccaauagaaauuca

SEQ ID NO: 38463 - RNA, 16 nt, Homo sapiens
uguuuugacacuuggc

SEQ ID NO: 38464 - RNA, 19 nt, Homo sapiens
aagcgggguggguuguggc

SEQ ID NO: 38465 - RNA, 18 nt, Homo sapiens
agaauauauaaaaaauga

SEQ ID NO: 38466 - RNA, 19 nt, Homo sapiens
aggcaucgcgcacguccag

SEQ ID NO: 38467 - RNA, 17 nt, Homo sapiens
ccagccagccccuccuc

SEQ ID NO: 38468 - RNA, 19 nt, Homo sapiens
ccccccugagcuucccuag

SEQ ID NO: 38469 - RNA, 16 nt, Homo sapiens
cccgccgcccgcugcc

SEQ ID NO: 38470 - RNA, 18 nt, Homo sapiens
ccgccgcccgcugccugc

SEQ ID NO: 38471 - RNA, 17 nt, Homo sapiens
ccucuuucuuccuccgg

SEQ ID NO: 38472 - RNA, 22 nt, Homo sapiens
cgccuucccugagcgcgcccgc

SEQ ID NO: 38473 - RNA, 21 nt, Homo sapiens
gcagcagcuccgccacucggg

SEQ ID NO: 38474 - RNA, 18 nt, Homo sapiens
gcugcuccccgccgcccg

SEQ ID NO: 38475 - RNA, 22 nt, Homo sapiens
gcuuguguagagcccccucacc

SEQ ID NO: 38476 - RNA, 20 nt, Homo sapiens
guuacugccucuggugcccc

SEQ ID NO: 38477 - RNA, 21 nt, Homo sapiens
uaagaauauauaaaaaaugau

SEQ ID NO: 38478 - RNA, 21 nt, Homo sapiens
aaggacaauguggacacgcua

SEQ ID NO: 38479 - RNA, 23 nt, Homo sapiens
agggugggugggcaggcagcggg

SEQ ID NO: 38480 - RNA, 22 nt, Homo sapiens
ucucuuuuccuucuucaucugu

SEQ ID NO: 38481 - RNA, 30 nt, Homo sapiens
uuuaucagcucuucaccuuuggugcuaaau

SEQ ID NO: 38482 - RNA, 17 nt, Homo sapiens
uuugauggagugaggcu

SEQ ID NO: 38483 - RNA, 17 nt, Homo sapiens
cugugcauuccuucugg

SEQ ID NO: 38484 - RNA, 21 nt, Homo sapiens
guaacaaguccacuuguacac

SEQ ID NO: 38485 - RNA, 26 nt, Homo sapiens
uacaaaauacuacuuucauaauaugu

SEQ ID NO: 38486 - RNA, 16 nt, Homo sapiens
uccacuuguacacauu

SEQ ID NO: 38487 - RNA, 17 nt, Homo sapiens
acaguagcacaaccacc

SEQ ID NO: 38488 - RNA, 21 nt, Homo sapiens
acauagcauuucaaauucaau

SEQ ID NO: 38489 - RNA, 20 nt, Homo sapiens
agguuuaauuucauuuuuau

SEQ ID NO: 38490 - RNA, 23 nt, Homo sapiens
aguccuuggauuauguaccacug

SEQ ID NO: 38491 - RNA, 16 nt, Homo sapiens
caagccuucagaaagu

SEQ ID NO: 38492 - RNA, 19 nt, Homo sapiens
cacaguguauaugaccauc

SEQ ID NO: 38493 - RNA, 18 nt, Homo sapiens
gcaguggcagcaacagca

SEQ ID NO: 38494 - RNA, 17 nt, Homo sapiens
ucaaaucacaguaaucc

SEQ ID NO: 38495 - RNA, 18 nt, Homo sapiens
uccuccuccgcccgcucc

SEQ ID NO: 38496 - RNA, 22 nt, Homo sapiens
ugaaggcaaaauuucagugccu

SEQ ID NO: 38497 - RNA, 24 nt, Homo sapiens
ugagauuaaacucuaauauuuaca

SEQ ID NO: 38498 - RNA, 17 nt, Homo sapiens
uggcaaauuagguaauu

SEQ ID NO: 38499 - RNA, 23 nt, Homo sapiens
uuacagagugaaaagugaauaca

SEQ ID NO: 38500 - RNA, 19 nt, Homo sapiens
uucaagauuagcugauaaa

SEQ ID NO: 38501 - RNA, 14 nt, Homo sapiens
agaggagggggcgg

SEQ ID NO: 38502 - RNA, 25 nt, Homo sapiens
cagggacacacgcgggcacgcuugg

SEQ ID NO: 38503 - RNA, 18 nt, Homo sapiens
cauccucgcggacacgca

SEQ ID NO: 38504 - RNA, 18 nt, Homo sapiens
ccagccccauaugagccc

SEQ ID NO: 38505 - RNA, 17 nt, Homo sapiens
ccggcccgggguccccu

SEQ ID NO: 38506 - RNA, 23 nt, Homo sapiens
ccucacccccacagcuagaggag

SEQ ID NO: 38507 - RNA, 18 nt, Homo sapiens
gagcugggggugggggug

SEQ ID NO: 38508 - RNA, 26 nt, Homo sapiens
gcccuucuucuugugugucccuuccg

SEQ ID NO: 38509 - RNA, 17 nt, Homo sapiens
gccggcccggggucccc

SEQ ID NO: 38510 - RNA, 17 nt, Homo sapiens
gcuggggggcagggggc

SEQ ID NO: 38511 - RNA, 19 nt, Homo sapiens
gggacaggcaccucagagc

SEQ ID NO: 38512 - RNA, 17 nt, Homo sapiens
ggugaggccccuucaaa

SEQ ID NO: 38513 - RNA, 19 nt, Homo sapiens
uaauucuaaugccagaggc

SEQ ID NO: 38514 - RNA, 20 nt, Homo sapiens
ccgagcuggggcaccugcuc

SEQ ID NO: 38515 - RNA, 18 nt, Homo sapiens
cggcuucaacuucucaag

SEQ ID NO: 38516 - RNA, 20 nt, Homo sapiens
gggcaccugcucgccagugu

SEQ ID NO: 38517 - RNA, 22 nt, Homo sapiens
uccacaacccagggcucugugg

SEQ ID NO: 38518 - RNA, 18 nt, Homo sapiens
uccagcaucucuuuuugc

SEQ ID NO: 38519 - RNA, 22 nt, Homo sapiens
ucgccaguguuacugucuccau

SEQ ID NO: 38520 - RNA, 20 nt, Homo sapiens
uuuaggguaaccacacuuaa

SEQ ID NO: 38521 - RNA, 19 nt, Homo sapiens
agccucaggcaguggcccc

SEQ ID NO: 38522 - RNA, 19 nt, Homo sapiens
aggagcggcaggggaaaga

SEQ ID NO: 38523 - RNA, 16 nt, Homo sapiens
uagcuuaagagggaag

SEQ ID NO: 38524 - RNA, 18 nt, Homo sapiens
ucugacaucagucuuagc

SEQ ID NO: 38525 - RNA, 18 nt, Homo sapiens
agcccagcuuuauaaaga

SEQ ID NO: 38526 - RNA, 18 nt, Homo sapiens
aggggaggcagguaggaa

SEQ ID NO: 38527 - RNA, 20 nt, Homo sapiens
cagaaaaggugaaaacauga

SEQ ID NO: 38528 - RNA, 20 nt, Homo sapiens
ggggacacauggggcagggg

SEQ ID NO: 38529 - RNA, 16 nt, Homo sapiens
ugaguugggcgaggug

SEQ ID NO: 38530 - RNA, 15 nt, Homo sapiens
uggcacaagauaggg

SEQ ID NO: 38531 - RNA, 18 nt, Homo sapiens
ugucagucuuggcacaag

SEQ ID NO: 38532 - RNA, 16 nt, Homo sapiens
ccaaagcguccaggcc

SEQ ID NO: 38533 - RNA, 22 nt, Homo sapiens
cccgccgcuaaucccuuggccc

SEQ ID NO: 38534 - RNA, 14 nt, Homo sapiens
gcccgccgcccgcc

SEQ ID NO: 38535 - RNA, 17 nt, Homo sapiens
ggcccggcucugcagcc

SEQ ID NO: 38536 - RNA, 16 nt, Homo sapiens
uagcauagguggcacu

SEQ ID NO: 38537 - RNA, 23 nt, Homo sapiens
ucaagggagguguuugguuuucu

SEQ ID NO: 38538 - RNA, 17 nt, Homo sapiens
agaguggcagggucugc

SEQ ID NO: 38539 - RNA, 18 nt, Homo sapiens
agccuucaucgaauuagg

SEQ ID NO: 38540 - RNA, 19 nt, Homo sapiens
aggcaucgcgcacguccag

SEQ ID NO: 38541 - RNA, 16 nt, Homo sapiens
ccacuaguuauguuac

SEQ ID NO: 38542 - RNA, 27 nt, Homo sapiens
ccuagcaugugugugugugugugugua

SEQ ID NO: 38543 - RNA, 16 nt, Homo sapiens
ccucagucuucagguu

SEQ ID NO: 38544 - RNA, 16 nt, Homo sapiens
ccugcggaacccgcgg

SEQ ID NO: 38545 - RNA, 19 nt, Homo sapiens
cuuucccacgcugcuccgg

SEQ ID NO: 38546 - RNA, 18 nt, Homo sapiens
gcgucagucccccguggc

SEQ ID NO: 38547 - RNA, 18 nt, Homo sapiens
gcuccgccacgcgggcgc

SEQ ID NO: 38548 - RNA, 19 nt, Homo sapiens
ggccggucguuagcuccgg

SEQ ID NO: 38549 - RNA, 15 nt, Homo sapiens
gguggaguugggcga

SEQ ID NO: 38550 - RNA, 19 nt, Homo sapiens
gucgcgguggccccgcucc

SEQ ID NO: 38551 - RNA, 21 nt, Homo sapiens
uauggcauaaguaagcaguuu

SEQ ID NO: 38552 - RNA, 19 nt, Homo sapiens
uccgcuucucuguguuucg

SEQ ID NO: 38553 - RNA, 18 nt, Homo sapiens
ucugcggcuuggggcccc

SEQ ID NO: 38554 - RNA, 23 nt, Homo sapiens
ugaguuugcaacagugccauugc

SEQ ID NO: 38555 - RNA, 17 nt, Homo sapiens
uggugagugucgagggc

SEQ ID NO: 38556 - RNA, 18 nt, Homo sapiens
ugugugugugugugugug

SEQ ID NO: 38557 - RNA, 19 nt, Homo sapiens
cagggggacacugagaguc

SEQ ID NO: 38558 - RNA, 23 nt, Homo sapiens
caggucccgggacucccggcagc

SEQ ID NO: 38559 - RNA, 18 nt, Homo sapiens
ccgcagccccgccgagcc

SEQ ID NO: 38560 - RNA, 18 nt, Homo sapiens
ccggccccgccagguccc

SEQ ID NO: 38561 - RNA, 20 nt, Homo sapiens
cuucuccagaagagccuuug

SEQ ID NO: 38562 - RNA, 22 nt, Homo sapiens
gagcgcuuuuugaguugaaaaa

SEQ ID NO: 38563 - RNA, 23 nt, Homo sapiens
gcccuggagcagagccuggcagc

SEQ ID NO: 38564 - RNA, 21 nt, Homo sapiens
gcucggcgcgcgucuccggag

SEQ ID NO: 38565 - RNA, 20 nt, Homo sapiens
gcugccgggcgugcggcggg

SEQ ID NO: 38566 - RNA, 19 nt, Homo sapiens
ggcagccaguccggucgcc

SEQ ID NO: 38567 - RNA, 16 nt, Homo sapiens
ucgccgcaguuccggg

SEQ ID NO: 38568 - RNA, 19 nt, Homo sapiens
ucuucaacuuggguguuga

SEQ ID NO: 38569 - RNA, 15 nt, Homo sapiens
ugccaccucucgcgg

SEQ ID NO: 38570 - RNA, 17 nt, Homo sapiens
ugcccuggagcagagcc

SEQ ID NO: 38571 - RNA, 19 nt, Homo sapiens
uggcuggaugcugacgugc

SEQ ID NO: 38572 - RNA, 17 nt, Homo sapiens
uguugagauuggcaaaa

SEQ ID NO: 38573 - RNA, 18 nt, Homo sapiens
uuaggguccugacgauca

SEQ ID NO: 38574 - RNA, 20 nt, Homo sapiens
aaaguaacaagugucguguc

SEQ ID NO: 38575 - RNA, 20 nt, Homo sapiens
agagggaaccguuagaagca

SEQ ID NO: 38576 - RNA, 21 nt, Homo sapiens
aggcggugcgccguggccggg

SEQ ID NO: 38577 - RNA, 23 nt, Homo sapiens
auaucucaaucaagcuguuuuaa

SEQ ID NO: 38578 - RNA, 17 nt, Homo sapiens
cacagcugcagccuccc

SEQ ID NO: 38579 - RNA, 17 nt, Homo sapiens
caccaggcaaccugcag

SEQ ID NO: 38580 - RNA, 20 nt, Homo sapiens
cacgaauauuucacugugaa

SEQ ID NO: 38581 - RNA, 23 nt, Homo sapiens
cauggcaccuguuuuagcaguuu

SEQ ID NO: 38582 - RNA, 17 nt, Homo sapiens
ccccugaaggagucagc

SEQ ID NO: 38583 - RNA, 19 nt, Homo sapiens
cggggcgggcggagcgcgc

SEQ ID NO: 38584 - RNA, 15 nt, Homo sapiens
cggugggggagggcg

SEQ ID NO: 38585 - RNA, 21 nt, Homo sapiens
cugugauggggugacacaauc

SEQ ID NO: 38586 - RNA, 18 nt, Homo sapiens
gcgggcgggggcggggag

SEQ ID NO: 38587 - RNA, 22 nt, Homo sapiens
ggaggcggugcgccguggccgg

SEQ ID NO: 38588 - RNA, 18 nt, Homo sapiens
ggcgggggcggggaggcg

SEQ ID NO: 38589 - RNA, 21 nt, Homo sapiens
gggagggcgggcgggggcggg

SEQ ID NO: 38590 - RNA, 21 nt, Homo sapiens
gggcgggcggagcgcgcgcgg

SEQ ID NO: 38591 - RNA, 19 nt, Homo sapiens
ggggagggcgggcgggggc

SEQ ID NO: 38592 - RNA, 21 nt, Homo sapiens
ggggagggcgggcgggggcgg

SEQ ID NO: 38593 - RNA, 20 nt, Homo sapiens
ggggugacacaaucaacaag

SEQ ID NO: 38594 - RNA, 19 nt, Homo sapiens
uagaucaccaaaaauaaca

SEQ ID NO: 38595 - RNA, 16 nt, Homo sapiens
ucaggcgagcuacagc

SEQ ID NO: 38596 - RNA, 21 nt, Homo sapiens
uuuuaaaaaagcaccugauuu

SEQ ID NO: 38597 - RNA, 19 nt, Homo sapiens
agcauaggcuaaacaacca

SEQ ID NO: 38598 - RNA, 18 nt, Homo sapiens
gcgggcgggggcggggag

SEQ ID NO: 38599 - RNA, 18 nt, Homo sapiens
ggcgggggcggggaggcg

SEQ ID NO: 38600 - RNA, 21 nt, Homo sapiens
ggggagggcgggcgggggcgg

SEQ ID NO: 38601 - RNA, 21 nt, Homo sapiens
uaaagguaugccuucuucaac

SEQ ID NO: 38602 - RNA, 19 nt, Homo sapiens
uagaucaccaaaaauaaca

SEQ ID NO: 38603 - RNA, 17 nt, Homo sapiens
ucuuucaaacaagacag

SEQ ID NO: 38604 - RNA, 18 nt, Homo sapiens
agagcagcagacacuuug

SEQ ID NO: 38605 - RNA, 22 nt, Homo sapiens
augaugguaaacagaucuggau

SEQ ID NO: 38606 - RNA, 20 nt, Homo sapiens
ggaguuccuccaaaagaacc

SEQ ID NO: 38607 - RNA, 18 nt, Homo sapiens
uggaagaggauggugguu

SEQ ID NO: 38608 - RNA, 24 nt, Homo sapiens
accccggcccucccggcgggcucc

SEQ ID NO: 38609 - RNA, 18 nt, Homo sapiens
cccggggcgcggccgcgg

SEQ ID NO: 38610 - RNA, 16 nt, Homo sapiens
cggccgcccgcggggc

SEQ ID NO: 38611 - RNA, 16 nt, Homo sapiens
gagccgggcccaaccc

SEQ ID NO: 38612 - RNA, 21 nt, Homo sapiens
gccgcccgcggggcccugccc

SEQ ID NO: 38613 - RNA, 21 nt, Homo sapiens
ggacgcuccccccacccccca

SEQ ID NO: 38614 - RNA, 20 nt, Homo sapiens
ucuuuuaaaacgcuguacaa

SEQ ID NO: 38615 - RNA, 21 nt, Homo sapiens
cuggggguggcaguggagugg

SEQ ID NO: 38616 - RNA, 14 nt, Homo sapiens
gaaagcagccacgc

SEQ ID NO: 38617 - RNA, 17 nt, Homo sapiens
ugagcuccuccgcugcc

SEQ ID NO: 38618 - RNA, 18 nt, Homo sapiens
aaaaaaaaaaaaaagcca

SEQ ID NO: 38619 - RNA, 18 nt, Homo sapiens
agccuuuacuacauuuag

SEQ ID NO: 38620 - RNA, 21 nt, Homo sapiens
agggggcaguuuggaaaacac

SEQ ID NO: 38621 - RNA, 19 nt, Homo sapiens
auuccuuuucucuuucucu

SEQ ID NO: 38622 - RNA, 17 nt, Homo sapiens
cacacacacacaccccc

SEQ ID NO: 38623 - RNA, 18 nt, Homo sapiens
cacauagccggucaacau

SEQ ID NO: 38624 - RNA, 19 nt, Homo sapiens
ccucgcgccgugcccggcc

SEQ ID NO: 38625 - RNA, 18 nt, Homo sapiens
cggcgcgcgacacccggc

SEQ ID NO: 38626 - RNA, 23 nt, Homo sapiens
cggcggcggcggcggcgcgucuc

SEQ ID NO: 38627 - RNA, 23 nt, Homo sapiens
cggcggcggcggcggcggcgcgu

SEQ ID NO: 38628 - RNA, 19 nt, Homo sapiens
cgggggaaaagggagaugu

SEQ ID NO: 38629 - RNA, 18 nt, Homo sapiens
cuuaaacauuuuauucau

SEQ ID NO: 38630 - RNA, 22 nt, Homo sapiens
gaagacaaguuucugggauaac

SEQ ID NO: 38631 - RNA, 18 nt, Homo sapiens
gauggacacugcgcgugc

SEQ ID NO: 38632 - RNA, 16 nt, Homo sapiens
gcccggccgccgcugc

SEQ ID NO: 38633 - RNA, 17 nt, Homo sapiens
gcccggccgccgcugcc

SEQ ID NO: 38634 - RNA, 20 nt, Homo sapiens
gcggcggcggcgacgacucc

SEQ ID NO: 38635 - RNA, 16 nt, Homo sapiens
gcggcggcggcggcgc

SEQ ID NO: 38636 - RNA, 19 nt, Homo sapiens
gcggcggcggcggcggcgc

SEQ ID NO: 38637 - RNA, 20 nt, Homo sapiens
guggcggcggcggcgacgac

SEQ ID NO: 38638 - RNA, 17 nt, Homo sapiens
uaacugccuuccacaaa

SEQ ID NO: 38639 - RNA, 22 nt, Homo sapiens
uagaggugaaaauagugcaaga

SEQ ID NO: 38640 - RNA, 18 nt, Homo sapiens
uagcuuagcagguaugcu

SEQ ID NO: 38641 - RNA, 19 nt, Homo sapiens
ucagaguaacgcuacagcc

SEQ ID NO: 38642 - RNA, 19 nt, Homo sapiens
ucagcgaaaaugcugugcu

SEQ ID NO: 38643 - RNA, 17 nt, Homo sapiens
ucgguguccaggagucu

SEQ ID NO: 38644 - RNA, 23 nt, Homo sapiens
ucuauauuaauggaaucuauugu

SEQ ID NO: 38645 - RNA, 23 nt, Homo sapiens
ugaaaauagugcaagagccccug

SEQ ID NO: 38646 - RNA, 18 nt, Homo sapiens
uucacauuuccagguacc

SEQ ID NO: 38647 - RNA, 19 nt, Homo sapiens
cccgggcggggccggcucc

SEQ ID NO: 38648 - RNA, 19 nt, Homo sapiens
ccuaguagacaggaaggca

SEQ ID NO: 38649 - RNA, 18 nt, Homo sapiens
ggacuugguuggggaggg

SEQ ID NO: 38650 - RNA, 21 nt, Homo sapiens
ugcccuggguuuuccacuucc

SEQ ID NO: 38651 - RNA, 17 nt, Homo sapiens
uggcaguagcugaaggg

SEQ ID NO: 38652 - RNA, 18 nt, Homo sapiens
caacauggugacugagag

SEQ ID NO: 38653 - RNA, 22 nt, Homo sapiens
agcuggcccggaggucccagcc

SEQ ID NO: 38654 - RNA, 17 nt, Homo sapiens
cacccacgucaaacaug

SEQ ID NO: 38655 - RNA, 19 nt, Homo sapiens
caggauccucaucugcuuc

SEQ ID NO: 38656 - RNA, 16 nt, Homo sapiens
caggauguaguccacu

SEQ ID NO: 38657 - RNA, 22 nt, Homo sapiens
cggaggucccagccucaccucc

SEQ ID NO: 38658 - RNA, 18 nt, Homo sapiens
cggcggcggcggcggcgg

SEQ ID NO: 38659 - RNA, 18 nt, Homo sapiens
cggcggggcgcggccggg

SEQ ID NO: 38660 - RNA, 19 nt, Homo sapiens
cuccacggggggcaccagg

SEQ ID NO: 38661 - RNA, 24 nt, Homo sapiens
gcaaaaucacucgggggcuuuuga

SEQ ID NO: 38662 - RNA, 19 nt, Homo sapiens
ggcggcggcggggcgcggc

SEQ ID NO: 38663 - RNA, 18 nt, Homo sapiens
ggggaagggaaagguugc

SEQ ID NO: 38664 - RNA, 20 nt, Homo sapiens
ggguccucuucgccgcccuc

SEQ ID NO: 38665 - RNA, 17 nt, Homo sapiens
ucugagcaagaagaagg

SEQ ID NO: 38666 - RNA, 17 nt, Homo sapiens
uggccuuuuuuccuuuu

SEQ ID NO: 38667 - RNA, 21 nt, Homo sapiens
uguagcugcugcuggccacca

SEQ ID NO: 38668 - RNA, 18 nt, Homo sapiens
uucaucacacucaggaug

SEQ ID NO: 38669 - RNA, 21 nt, Homo sapiens
uuggagcguucguagcaggca

SEQ ID NO: 38670 - RNA, 19 nt, Homo sapiens
ugccugggagaggacagag

SEQ ID NO: 38671 - RNA, 18 nt, Homo sapiens
aaggggccagagggagga

SEQ ID NO: 38672 - RNA, 20 nt, Homo sapiens
agggggcuggaaggaagccu

SEQ ID NO: 38673 - RNA, 21 nt, Homo sapiens
agugggcagaggaggugccuu

SEQ ID NO: 38674 - RNA, 21 nt, Homo sapiens
cacagcccaugggcacaagcu

SEQ ID NO: 38675 - RNA, 17 nt, Homo sapiens
cagaaugguugugcuuu

SEQ ID NO: 38676 - RNA, 24 nt, Homo sapiens
cccaguggccggagggaagauagc

SEQ ID NO: 38677 - RNA, 17 nt, Homo sapiens
ccugccucugacaccaa

SEQ ID NO: 38678 - RNA, 19 nt, Homo sapiens
ccuugacucccuggguugg

SEQ ID NO: 38679 - RNA, 19 nt, Homo sapiens
gaacuaugcaugcucaugg

SEQ ID NO: 38680 - RNA, 20 nt, Homo sapiens
gcccuugggccuagaguggc

SEQ ID NO: 38681 - RNA, 17 nt, Homo sapiens
gccuaccucaggcacuc

SEQ ID NO: 38682 - RNA, 19 nt, Homo sapiens
gcuuggucgcccagcuugg

SEQ ID NO: 38683 - RNA, 20 nt, Homo sapiens
uccagaguucuggggaccca

SEQ ID NO: 38684 - RNA, 15 nt, Homo sapiens
ucccugaugucaagu

SEQ ID NO: 38685 - RNA, 18 nt, Homo sapiens
ucugucguauggggcccc

SEQ ID NO: 38686 - RNA, 18 nt, Homo sapiens
ugccugucccaggguucc

SEQ ID NO: 38687 - RNA, 23 nt, Homo sapiens
ugggagcugaaaggggaaugggg

SEQ ID NO: 38688 - RNA, 14 nt, Homo sapiens
uguggcugcugcgg

SEQ ID NO: 38689 - RNA, 20 nt, Homo sapiens
aagacaggaugcaguggucc

SEQ ID NO: 38690 - RNA, 15 nt, Homo sapiens
aagggugucccucca

SEQ ID NO: 38691 - RNA, 16 nt, Homo sapiens
agcugcugccaguucu

SEQ ID NO: 38692 - RNA, 20 nt, Homo sapiens
aggucucagguugggcaugu

SEQ ID NO: 38693 - RNA, 20 nt, Homo sapiens
caccuuggagaugucuuucc

SEQ ID NO: 38694 - RNA, 18 nt, Homo sapiens
gcguguguuugugugugu

SEQ ID NO: 38695 - RNA, 15 nt, Homo sapiens
ucauaggccuagaga

SEQ ID NO: 38696 - RNA, 16 nt, Homo sapiens
ugcuguuugcgugcgc

SEQ ID NO: 38697 - RNA, 18 nt, Homo sapiens
uggccagggucuggcgag

SEQ ID NO: 38698 - RNA, 19 nt, Homo sapiens
ugguggaagcagcaugaaa

SEQ ID NO: 38699 - RNA, 21 nt, Homo sapiens
uguguuugugugugugugugu

SEQ ID NO: 38700 - RNA, 22 nt, Homo sapiens
cuugaggucugcugugggggug

SEQ ID NO: 38701 - RNA, 17 nt, Homo sapiens
gcagggcguggagucga

SEQ ID NO: 38702 - RNA, 16 nt, Homo sapiens
ugcugcggagccuugc

SEQ ID NO: 38703 - RNA, 22 nt, Homo sapiens
agggggcgcagggaaugaggag

SEQ ID NO: 38704 - RNA, 15 nt, Homo sapiens
cucuguagggagggg

SEQ ID NO: 38705 - RNA, 22 nt, Homo sapiens
aaauauuuauuuucugcagacu

SEQ ID NO: 38706 - RNA, 17 nt, Homo sapiens
cagaaguccauggagau

SEQ ID NO: 38707 - RNA, 22 nt, Homo sapiens
cuuccggcaacugucgacggcc

SEQ ID NO: 38708 - RNA, 19 nt, Homo sapiens
aagaguaguuggugggagu

SEQ ID NO: 38709 - RNA, 15 nt, Homo sapiens
aggggcggcgugccg

SEQ ID NO: 38710 - RNA, 17 nt, Homo sapiens
caccugggccaccggag

SEQ ID NO: 38711 - RNA, 17 nt, Homo sapiens
cauccaagaagucuuua

SEQ ID NO: 38712 - RNA, 23 nt, Homo sapiens
gagaugggguuggggggacagug

SEQ ID NO: 38713 - RNA, 18 nt, Homo sapiens
gaggugugggcaagucca

SEQ ID NO: 38714 - RNA, 22 nt, Homo sapiens
gauguugagacuuggagaucag

SEQ ID NO: 38715 - RNA, 14 nt, Homo sapiens
uccauccccaaggc

SEQ ID NO: 38716 - RNA, 21 nt, Homo sapiens
ucuaggacggaagggagaaag

SEQ ID NO: 38717 - RNA, 22 nt, Homo sapiens
ucucagauucaaggaggaggaa

SEQ ID NO: 38718 - RNA, 18 nt, Homo sapiens
ucugucuuugagggcuga

SEQ ID NO: 38719 - RNA, 20 nt, Homo sapiens
ugccaggccuggucaccucu

SEQ ID NO: 38720 - RNA, 21 nt, Homo sapiens
ugcuugggcaggaccucgggu

SEQ ID NO: 38721 - RNA, 19 nt, Homo sapiens
ugucaggggcggcgugccu

SEQ ID NO: 38722 - RNA, 19 nt, Homo sapiens
uuggagcugguugggcagc

SEQ ID NO: 38723 - RNA, 20 nt, Homo sapiens
caggguccucuccuaacugc

SEQ ID NO: 38724 - RNA, 20 nt, Homo sapiens
aacuuuagaaagcgaauuuu

SEQ ID NO: 38725 - RNA, 21 nt, Homo sapiens
acagugaugggcccaaggauc

SEQ ID NO: 38726 - RNA, 16 nt, Homo sapiens
agaaugcugcuuuccu

SEQ ID NO: 38727 - RNA, 22 nt, Homo sapiens
agaggauucucaagcaaaguaa

SEQ ID NO: 38728 - RNA, 19 nt, Homo sapiens
agccagcuguggggaugag

SEQ ID NO: 38729 - RNA, 23 nt, Homo sapiens
agguccugagaaaagggucucag

SEQ ID NO: 38730 - RNA, 18 nt, Homo sapiens
cacagccacaccuagauu

SEQ ID NO: 38731 - RNA, 16 nt, Homo sapiens
ccagcccauccccucc

SEQ ID NO: 38732 - RNA, 21 nt, Homo sapiens
ccaucuugucagagccagcug

SEQ ID NO: 38733 - RNA, 19 nt, Homo sapiens
cucagagcuggaguggagg

SEQ ID NO: 38734 - RNA, 17 nt, Homo sapiens
cuguccucucucucugc

SEQ ID NO: 38735 - RNA, 20 nt, Homo sapiens
cuguguccccacaccuguua

SEQ ID NO: 38736 - RNA, 18 nt, Homo sapiens
gcccuggccucagcacuc

SEQ ID NO: 38737 - RNA, 20 nt, Homo sapiens
gcgugcgccucgcacacugc

SEQ ID NO: 38738 - RNA, 21 nt, Homo sapiens
gcugcagccuccuccguucug

SEQ ID NO: 38739 - RNA, 16 nt, Homo sapiens
gggcugucugcccuga

SEQ ID NO: 38740 - RNA, 21 nt, Homo sapiens
ggguuagaagggaagucacac

SEQ ID NO: 38741 - RNA, 18 nt, Homo sapiens
ggugcccccucuguugua

SEQ ID NO: 38742 - RNA, 20 nt, Homo sapiens
gugcccccucuguuguaugc

SEQ ID NO: 38743 - RNA, 14 nt, Homo sapiens
uccaguguugccuc

SEQ ID NO: 38744 - RNA, 22 nt, Homo sapiens
uccugaaaagggcagugccugg

SEQ ID NO: 38745 - RNA, 24 nt, Homo sapiens
caagagcgcaggcgcaagggaccg

SEQ ID NO: 38746 - RNA, 16 nt, Homo sapiens
gagugaucgcugaauc

SEQ ID NO: 38747 - RNA, 21 nt, Homo sapiens
ggcaggagaccaggcaggaag

SEQ ID NO: 38748 - RNA, 20 nt, Homo sapiens
ggucagccacgcaggcugcc

SEQ ID NO: 38749 - RNA, 20 nt, Homo sapiens
uccccugccuuccagggucu

SEQ ID NO: 38750 - RNA, 18 nt, Homo sapiens
aaugccagugcaaagguc

SEQ ID NO: 38751 - RNA, 18 nt, Homo sapiens
acaucgggcuggcccgag

SEQ ID NO: 38752 - RNA, 18 nt, Homo sapiens
cagcugccccccggcccg

SEQ ID NO: 38753 - RNA, 17 nt, Homo sapiens
ccaggccuggggauccc

SEQ ID NO: 38754 - RNA, 23 nt, Homo sapiens
ccuccuccgcccccgcccuucgc

SEQ ID NO: 38755 - RNA, 15 nt, Homo sapiens
ccugcuucccgucag

SEQ ID NO: 38756 - RNA, 22 nt, Homo sapiens
ggccuagaggggcuccucuggg

SEQ ID NO: 38757 - RNA, 18 nt, Homo sapiens
gggggcuccgcggaggcg

SEQ ID NO: 38758 - RNA, 18 nt, Homo sapiens
ucgcuccuccuccgcccc

SEQ ID NO: 38759 - RNA, 17 nt, Homo sapiens
cccuccggccgcgaccc

SEQ ID NO: 38760 - RNA, 21 nt, Homo sapiens
gcguucuucgugucucuagcc

SEQ ID NO: 38761 - RNA, 25 nt, Homo sapiens
aaucaguuacuuaaaaaugaagacu

SEQ ID NO: 38762 - RNA, 19 nt, Homo sapiens
cuaauguuauucccaggug

SEQ ID NO: 38763 - RNA, 19 nt, Homo sapiens
ugaaaacuagcaguguagc

SEQ ID NO: 38764 - RNA, 19 nt, Homo sapiens
caccagcacagcggcuccc

SEQ ID NO: 38765 - RNA, 17 nt, Homo sapiens
gcuuggccggaacgggg

SEQ ID NO: 38766 - RNA, 22 nt, Homo sapiens
gcuuggccggaacgggguuacc

SEQ ID NO: 38767 - RNA, 18 nt, Homo sapiens
uauccuucacuguaccug

SEQ ID NO: 38768 - RNA, 23 nt, Homo sapiens
gaggacccugagcccuggugggc

SEQ ID NO: 38769 - RNA, 19 nt, Homo sapiens
gcccuuggggcaggguggc

SEQ ID NO: 38770 - RNA, 24 nt, Homo sapiens
uccagcugugcagguggcgccgcg

SEQ ID NO: 38771 - RNA, 21 nt, Homo sapiens
ugcccuuggggcaggguggcc

SEQ ID NO: 38772 - RNA, 14 nt, Homo sapiens
gcagccuagcuccu

SEQ ID NO: 38773 - RNA, 18 nt, Homo sapiens
ccauguccuuucucuucu

SEQ ID NO: 38774 - RNA, 17 nt, Homo sapiens
acgccggggucccaggg

SEQ ID NO: 38775 - RNA, 18 nt, Homo sapiens
gaaggugggagggaggug

SEQ ID NO: 38776 - RNA, 19 nt, Homo sapiens
gcccuggcccagggcuccc

SEQ ID NO: 38777 - RNA, 17 nt, Homo sapiens
gcucccggcacugcucc

SEQ ID NO: 38778 - RNA, 17 nt, Homo sapiens
ggggaggacaggggugg

SEQ ID NO: 38779 - RNA, 21 nt, Homo sapiens
guugugggauuccaggugggc

SEQ ID NO: 38780 - RNA, 18 nt, Homo sapiens
aguugcauuuuuaggcca

SEQ ID NO: 38781 - RNA, 18 nt, Homo sapiens
gcuuauuauuugucuaua

SEQ ID NO: 38782 - RNA, 18 nt, Homo sapiens
uuaaggagagaaauggaa

SEQ ID NO: 38783 - RNA, 18 nt, Homo sapiens
uuggauagagagcaggag

SEQ ID NO: 38784 - RNA, 18 nt, Homo sapiens
uuaaggagagaaauggaa

SEQ ID NO: 38785 - RNA, 21 nt, Homo sapiens
gggaagggggaggaggggaag

SEQ ID NO: 38786 - RNA, 21 nt, Homo sapiens
cacagcacgcuuugcgggcau

SEQ ID NO: 38787 - RNA, 22 nt, Homo sapiens
ugguuaaaaucgcagugccaaa

SEQ ID NO: 38788 - RNA, 21 nt, Homo sapiens
ugaaggaagaggggggaaacg

SEQ ID NO: 38789 - RNA, 19 nt, Homo sapiens
acugcauuccagccugggu

SEQ ID NO: 38790 - RNA, 24 nt, Homo sapiens
agagguugcagugagccaagauca

SEQ ID NO: 38791 - RNA, 18 nt, Homo sapiens
aggcaguccugcggccac

SEQ ID NO: 38792 - RNA, 18 nt, Homo sapiens
cagagccaucugugguuc

SEQ ID NO: 38793 - RNA, 23 nt, Homo sapiens
cagcagccccccguggcaacggg

SEQ ID NO: 38794 - RNA, 21 nt, Homo sapiens
cggggagcaucuacggccugg

SEQ ID NO: 38795 - RNA, 15 nt, Homo sapiens
gagagagagagagag

SEQ ID NO: 38796 - RNA, 17 nt, Homo sapiens
ggaauccaggaggcgga

SEQ ID NO: 38797 - RNA, 16 nt, Homo sapiens
ggagagcugggcucgu

SEQ ID NO: 38798 - RNA, 16 nt, Homo sapiens
ggccucaggugccucc

SEQ ID NO: 38799 - RNA, 19 nt, Homo sapiens
gggagagcugggcucgugu

SEQ ID NO: 38800 - RNA, 15 nt, Homo sapiens
uaagugacugaccgg

SEQ ID NO: 38801 - RNA, 22 nt, Homo sapiens
ucucaccccagaggccucagag

SEQ ID NO: 38802 - RNA, 18 nt, Homo sapiens
ugaggauggcucagucca

SEQ ID NO: 38803 - RNA, 21 nt, Homo sapiens
uggacguggggaacacaggga

SEQ ID NO: 38804 - RNA, 17 nt, Homo sapiens
ugggaggguggacaggc

SEQ ID NO: 38805 - RNA, 17 nt, Homo sapiens
uugggaggccaaggcgg

SEQ ID NO: 38806 - RNA, 17 nt, Homo sapiens
uugggaggccgaggugg

SEQ ID NO: 38807 - RNA, 24 nt, Homo sapiens
ggacguggggaacacagggacggu

SEQ ID NO: 38808 - RNA, 20 nt, Homo sapiens
guucucuuggcuacugucuc

SEQ ID NO: 38809 - RNA, 18 nt, Homo sapiens
acacacauaccuggggcc

SEQ ID NO: 38810 - RNA, 25 nt, Homo sapiens
accccagcccugcuauguuuccucc

SEQ ID NO: 38811 - RNA, 19 nt, Homo sapiens
accccuuggugaccagcgc

SEQ ID NO: 38812 - RNA, 25 nt, Homo sapiens
acggcguccacaugggccaugaggg

SEQ ID NO: 38813 - RNA, 20 nt, Homo sapiens
agagggcugccaccaucuac

SEQ ID NO: 38814 - RNA, 19 nt, Homo sapiens
aguggcggaugacggcguc

SEQ ID NO: 38815 - RNA, 16 nt, Homo sapiens
cagcucaccaccaucc

SEQ ID NO: 38816 - RNA, 17 nt, Homo sapiens
cauggcaucagcacagc

SEQ ID NO: 38817 - RNA, 18 nt, Homo sapiens
ccacucccauccuggccc

SEQ ID NO: 38818 - RNA, 19 nt, Homo sapiens
ccagccgcccugcgcagug

SEQ ID NO: 38819 - RNA, 16 nt, Homo sapiens
ccgcugccucccacgg

SEQ ID NO: 38820 - RNA, 20 nt, Homo sapiens
ccuggcccagggccguuugc

SEQ ID NO: 38821 - RNA, 15 nt, Homo sapiens
ccuggucucagguuc

SEQ ID NO: 38822 - RNA, 18 nt, Homo sapiens
ccuugcccuggaaagaga

SEQ ID NO: 38823 - RNA, 22 nt, Homo sapiens
cgcagagggcagcgccuccucc

SEQ ID NO: 38824 - RNA, 18 nt, Homo sapiens
cgcccgggcccauggugc

SEQ ID NO: 38825 - RNA, 18 nt, Homo sapiens
gagcagccagcacaggcc

SEQ ID NO: 38826 - RNA, 18 nt, Homo sapiens
gcccgccaaaaccguccc

SEQ ID NO: 38827 - RNA, 16 nt, Homo sapiens
gcccuggaaagagagg

SEQ ID NO: 38828 - RNA, 19 nt, Homo sapiens
gcguggggcagggugaggc

SEQ ID NO: 38829 - RNA, 19 nt, Homo sapiens
ggcaagaccuccccaauua

SEQ ID NO: 38830 - RNA, 18 nt, Homo sapiens
gggagcaggggacagggc

SEQ ID NO: 38831 - RNA, 17 nt, Homo sapiens
ggguaauaaacacugcu

SEQ ID NO: 38832 - RNA, 22 nt, Homo sapiens
ggguggcagggaagggguccag

SEQ ID NO: 38833 - RNA, 20 nt, Homo sapiens
uaacagaguuugauuuguuu

SEQ ID NO: 38834 - RNA, 20 nt, Homo sapiens
uaccuggccuaaggaagggc

SEQ ID NO: 38835 - RNA, 22 nt, Homo sapiens
uccaaggauaauuugcugggua

SEQ ID NO: 38836 - RNA, 18 nt, Homo sapiens
uccccaaguccucugcgg

SEQ ID NO: 38837 - RNA, 20 nt, Homo sapiens
ucugcggucccuaagggcuu

SEQ ID NO: 38838 - RNA, 21 nt, Homo sapiens
ugaugcacguggauggguggc

SEQ ID NO: 38839 - RNA, 19 nt, Homo sapiens
ugcccugaccucucugccc

SEQ ID NO: 38840 - RNA, 19 nt, Homo sapiens
uggcaagaugagguagcac

SEQ ID NO: 38841 - RNA, 20 nt, Homo sapiens
uggcucugggggucccacuc

SEQ ID NO: 38842 - RNA, 19 nt, Homo sapiens
uguccuugacgcagaugcc

SEQ ID NO: 38843 - RNA, 15 nt, Homo sapiens
uuaccuaguacugcc

SEQ ID NO: 38844 - RNA, 18 nt, Homo sapiens
accgugggaccacgggga

SEQ ID NO: 38845 - RNA, 16 nt, Homo sapiens
ccgccuuccccucccu

SEQ ID NO: 38846 - RNA, 18 nt, Homo sapiens
ccuccgccuuccccuccc

SEQ ID NO: 38847 - RNA, 14 nt, Homo sapiens
cgacgcgccuggag

SEQ ID NO: 38848 - RNA, 19 nt, Homo sapiens
cuccuccuucgcuucuucc

SEQ ID NO: 38849 - RNA, 16 nt, Homo sapiens
gcuggcaggccuccgg

SEQ ID NO: 38850 - RNA, 19 nt, Homo sapiens
ggaaagaggggagagaacc

SEQ ID NO: 38851 - RNA, 22 nt, Homo sapiens
ggaggcaaggucgaccacugug

SEQ ID NO: 38852 - RNA, 21 nt, Homo sapiens
aguugagggggugggugggca

SEQ ID NO: 38853 - RNA, 17 nt, Homo sapiens
aguuuggcgcuuccggc

SEQ ID NO: 38854 - RNA, 17 nt, Homo sapiens
cggccagcugguccccg

SEQ ID NO: 38855 - RNA, 17 nt, Homo sapiens
cucccagagugcuggga

SEQ ID NO: 38856 - RNA, 18 nt, Homo sapiens
gagggggugggugggcag

SEQ ID NO: 38857 - RNA, 18 nt, Homo sapiens
gcccuggagggaagcagc

SEQ ID NO: 38858 - RNA, 25 nt, Homo sapiens
gggagguuugugauggaggcagagg

SEQ ID NO: 38859 - RNA, 20 nt, Homo sapiens
ggggaagggagcgggagguu

SEQ ID NO: 38860 - RNA, 16 nt, Homo sapiens
gggggguggggauuga

SEQ ID NO: 38861 - RNA, 23 nt, Homo sapiens
ucgaacuccuggccucaggugau

SEQ ID NO: 38862 - RNA, 23 nt, Homo sapiens
ucucgcugcuuagggcccccggu

SEQ ID NO: 38863 - RNA, 21 nt, Homo sapiens
ugcgugagccaccacaccugg

SEQ ID NO: 38864 - RNA, 18 nt, Homo sapiens
uggggaggccugguaagu

SEQ ID NO: 38865 - RNA, 15 nt, Homo sapiens
uuccagauccaggau

SEQ ID NO: 38866 - RNA, 25 nt, Homo sapiens
uugggcugggguggagaccccuggg

SEQ ID NO: 38867 - RNA, 19 nt, Homo sapiens
agaagggggagaaaaggag

SEQ ID NO: 38868 - RNA, 19 nt, Homo sapiens
agacggaggagaagcgaga

SEQ ID NO: 38869 - RNA, 19 nt, Homo sapiens
aggggaaggggaaaaaagg

SEQ ID NO: 38870 - RNA, 17 nt, Homo sapiens
cacagcacauuuuaacu

SEQ ID NO: 38871 - RNA, 18 nt, Homo sapiens
gcgcaagaggggcgagca

SEQ ID NO: 38872 - RNA, 21 nt, Homo sapiens
gggggcugggaucgagggcug

SEQ ID NO: 38873 - RNA, 17 nt, Homo sapiens
ggggguggggcggggag

SEQ ID NO: 38874 - RNA, 18 nt, Homo sapiens
gggguggggcggggaggg

SEQ ID NO: 38875 - RNA, 17 nt, Homo sapiens
gggguggggguggggcg

SEQ ID NO: 38876 - RNA, 20 nt, Homo sapiens
gggguggggguggggcgggg

SEQ ID NO: 38877 - RNA, 17 nt, Homo sapiens
guuguugucaacaucca

SEQ ID NO: 38878 - RNA, 21 nt, Homo sapiens
uaaaaugggcacauuuuacuu

SEQ ID NO: 38879 - RNA, 17 nt, Homo sapiens
uacaauuguccagcagc

SEQ ID NO: 38880 - RNA, 15 nt, Homo sapiens
uacauaauaccuucc

SEQ ID NO: 38881 - RNA, 18 nt, Homo sapiens
ucucugguaugaaccaca

SEQ ID NO: 38882 - RNA, 24 nt, Homo sapiens
ugaaaaggaggagguuugaaggac

SEQ ID NO: 38883 - RNA, 17 nt, Homo sapiens
uuaaguguuguaauccu

SEQ ID NO: 38884 - RNA, 16 nt, Homo sapiens
uuguacagauuuugua

SEQ ID NO: 38885 - RNA, 25 nt, Homo sapiens
cagcagcucgugguaucggggacag

SEQ ID NO: 38886 - RNA, 21 nt, Homo sapiens
cccagggcccccuggagggcc

SEQ ID NO: 38887 - RNA, 19 nt, Homo sapiens
ccucccgcagcagcucgug

SEQ ID NO: 38888 - RNA, 26 nt, Homo sapiens
cgacagucccgugaaguuggcuucgc

SEQ ID NO: 38889 - RNA, 18 nt, Homo sapiens
cgggccggggcagucagc

SEQ ID NO: 38890 - RNA, 23 nt, Homo sapiens
cugguaguggaagaccgugggcu

SEQ ID NO: 38891 - RNA, 18 nt, Homo sapiens
ggacagggggccgggcac

SEQ ID NO: 38892 - RNA, 23 nt, Homo sapiens
gugacauucccuccaucuuuggc

SEQ ID NO: 38893 - RNA, 19 nt, Homo sapiens
ugagaggcaggggcaggug

SEQ ID NO: 38894 - RNA, 21 nt, Homo sapiens
ugcaaggauagcauucagcag

SEQ ID NO: 38895 - RNA, 18 nt, Homo sapiens
cucccgggccagucaguu

SEQ ID NO: 38896 - RNA, 19 nt, Homo sapiens
ccugugggcaggcagaugu

SEQ ID NO: 38897 - RNA, 20 nt, Homo sapiens
ccugugggcaggcagauguc

SEQ ID NO: 38898 - RNA, 18 nt, Homo sapiens
ggagccugugggcaggca

SEQ ID NO: 38899 - RNA, 18 nt, Homo sapiens
cucucaaggcucuguaag

SEQ ID NO: 38900 - RNA, 18 nt, Homo sapiens
gaccgagcagcccagagg

SEQ ID NO: 38901 - RNA, 19 nt, Homo sapiens
gccccuggagucccacagc

SEQ ID NO: 38902 - RNA, 16 nt, Homo sapiens
ggcauggucugcagcu

SEQ ID NO: 38903 - RNA, 16 nt, Homo sapiens
ucuuggucauuucagu

SEQ ID NO: 38904 - RNA, 18 nt, Homo sapiens
aacaccgugaacaccagg

SEQ ID NO: 38905 - RNA, 19 nt, Homo sapiens
agugguggggaugggggag

SEQ ID NO: 38906 - RNA, 20 nt, Homo sapiens
caaacucauucuuggccuug

SEQ ID NO: 38907 - RNA, 17 nt, Homo sapiens
cccgcggcuccgagccc

SEQ ID NO: 38908 - RNA, 19 nt, Homo sapiens
ccgccgcccggcccgcggc

SEQ ID NO: 38909 - RNA, 22 nt, Homo sapiens
ccgccgcccggcccgcggcucc

SEQ ID NO: 38910 - RNA, 19 nt, Homo sapiens
ccucagggccgccgcccgg

SEQ ID NO: 38911 - RNA, 15 nt, Homo sapiens
cuuuaggagaagggg

SEQ ID NO: 38912 - RNA, 16 nt, Homo sapiens
gagggauauuuacagg

SEQ ID NO: 38913 - RNA, 17 nt, Homo sapiens
gcggcggcggcggcggc

SEQ ID NO: 38914 - RNA, 18 nt, Homo sapiens
gcggcggcggcggcggcc

SEQ ID NO: 38915 - RNA, 14 nt, Homo sapiens
uagaaggcaucggc

SEQ ID NO: 38916 - RNA, 27 nt, Homo sapiens
ucauguagagacaggucuagcuugugc

SEQ ID NO: 38917 - RNA, 16 nt, Homo sapiens
ugaggggcgacugggc

SEQ ID NO: 38918 - RNA, 17 nt, Homo sapiens
uggcgaggggaagcggc

SEQ ID NO: 38919 - RNA, 17 nt, Homo sapiens
ugguaacugugucaugu

SEQ ID NO: 38920 - RNA, 19 nt, Homo sapiens
uuacagugcauggugguac

SEQ ID NO: 38921 - RNA, 19 nt, Homo sapiens
uucaucuuuaggagaaggg

SEQ ID NO: 38922 - RNA, 24 nt, Homo sapiens
uaaagaaaacaaaaaaaagucauu

SEQ ID NO: 38923 - RNA, 17 nt, Homo sapiens
uggaaauuuguggcugc

SEQ ID NO: 38924 - RNA, 19 nt, Homo sapiens
cauccuuccaccucacucc

SEQ ID NO: 38925 - RNA, 19 nt, Homo sapiens
ccccagcccgcuccgcucc

SEQ ID NO: 38926 - RNA, 19 nt, Homo sapiens
ccccgcccggaccucgccc

SEQ ID NO: 38927 - RNA, 21 nt, Homo sapiens
ccccgcccucgcuuuccuuug

SEQ ID NO: 38928 - RNA, 22 nt, Homo sapiens
ccgcgccuccgggccgcguccg

SEQ ID NO: 38929 - RNA, 19 nt, Homo sapiens
ccgcuagcucgguccccgc

SEQ ID NO: 38930 - RNA, 26 nt, Homo sapiens
cgggaccccgcgccuccgggccgcgu

SEQ ID NO: 38931 - RNA, 16 nt, Homo sapiens
cggggggagggcggcc

SEQ ID NO: 38932 - RNA, 19 nt, Homo sapiens
gcccuuggccgccccgugc

SEQ ID NO: 38933 - RNA, 19 nt, Homo sapiens
gcggggagggggucccagg

SEQ ID NO: 38934 - RNA, 21 nt, Homo sapiens
gcggucgccauguggcagcaa

SEQ ID NO: 38935 - RNA, 17 nt, Homo sapiens
gcuucgggccggaccgg

SEQ ID NO: 38936 - RNA, 17 nt, Homo sapiens
ggauuucuuuauuaaca

SEQ ID NO: 38937 - RNA, 16 nt, Homo sapiens
ggcaggagacgggggg

SEQ ID NO: 38938 - RNA, 19 nt, Homo sapiens
ggcggggcgcccuggcccc

SEQ ID NO: 38939 - RNA, 23 nt, Homo sapiens
gggaaggagggguggaauuugca

SEQ ID NO: 38940 - RNA, 21 nt, Homo sapiens
ggggagggggucccagggagc

SEQ ID NO: 38941 - RNA, 18 nt, Homo sapiens
gggucccucagaccugcc

SEQ ID NO: 38942 - RNA, 19 nt, Homo sapiens
ucggagccucugcagcguc

SEQ ID NO: 38943 - RNA, 17 nt, Homo sapiens
ugcuguggccgggccgg

SEQ ID NO: 38944 - RNA, 17 nt, Homo sapiens
uggccagaggcugaugc

SEQ ID NO: 38945 - RNA, 20 nt, Homo sapiens
gugcugccuuaaaaacccca

SEQ ID NO: 38946 - RNA, 22 nt, Homo sapiens
uacuuggcagucugugcugccu

SEQ ID NO: 38947 - RNA, 17 nt, Homo sapiens
ucaaaggguagccuuug

SEQ ID NO: 38948 - RNA, 23 nt, Homo sapiens
uguggaacaggucccagcaaaag

SEQ ID NO: 38949 - RNA, 19 nt, Homo sapiens
ccucaaaauccucaacaga

SEQ ID NO: 38950 - RNA, 17 nt, Homo sapiens
ccuuggccaaggagggg

SEQ ID NO: 38951 - RNA, 17 nt, Homo sapiens
cgggcuggagcuggagc

SEQ ID NO: 38952 - RNA, 21 nt, Homo sapiens
cuuaaacuaccuccuuucucu

SEQ ID NO: 38953 - RNA, 20 nt, Homo sapiens
gagggcuggggcuggggcag

SEQ ID NO: 38954 - RNA, 21 nt, Homo sapiens
gcucugagggcuggggcuggg

SEQ ID NO: 38955 - RNA, 23 nt, Homo sapiens
ggugguggccuggguaggaucug

SEQ ID NO: 38956 - RNA, 16 nt, Homo sapiens
uacaaugaauuacaga

SEQ ID NO: 38957 - RNA, 19 nt, Homo sapiens
ucaguguuucuuccuuucc

SEQ ID NO: 38958 - RNA, 19 nt, Homo sapiens
uugcucagcucuuccccau

SEQ ID NO: 38959 - RNA, 21 nt, Homo sapiens
agugcaggcccaauuuugguc

SEQ ID NO: 38960 - RNA, 19 nt, Homo sapiens
ccuggggagaagccuggag

SEQ ID NO: 38961 - RNA, 26 nt, Homo sapiens
gggcuggggauggaaaggugguuggg

SEQ ID NO: 38962 - RNA, 21 nt, Homo sapiens
uauccagcaaguuuccaagac

SEQ ID NO: 38963 - RNA, 22 nt, Homo sapiens
uccagcuguacuuucaggcggc

SEQ ID NO: 38964 - RNA, 20 nt, Homo sapiens
uccuuucuccuccucccugg

SEQ ID NO: 38965 - RNA, 20 nt, Homo sapiens
ucucaugaggucuucuuguu

SEQ ID NO: 38966 - RNA, 16 nt, Homo sapiens
agggaagggcuccagc

SEQ ID NO: 38967 - RNA, 22 nt, Homo sapiens
ccaagacuuugggcagugcagg

SEQ ID NO: 38968 - RNA, 18 nt, Homo sapiens
uaaaagagaguagaaacc

SEQ ID NO: 38969 - RNA, 17 nt, Homo sapiens
uacugucaaguuuggga

SEQ ID NO: 38970 - RNA, 21 nt, Homo sapiens
augggggugguuccuauggac

SEQ ID NO: 38971 - RNA, 18 nt, Homo sapiens
cagaugagucaguugcag

SEQ ID NO: 38972 - RNA, 20 nt, Homo sapiens
cugcuuuuuccucccaugcu

SEQ ID NO: 38973 - RNA, 19 nt, Homo sapiens
gcagcucucucugcuccuc

SEQ ID NO: 38974 - RNA, 18 nt, Homo sapiens
gcuuccuccucuuccuuc

SEQ ID NO: 38975 - RNA, 24 nt, Homo sapiens
uccugaggcucuccucucucuucu

SEQ ID NO: 38976 - RNA, 14 nt, Homo sapiens
ucucuccaugauga

SEQ ID NO: 38977 - RNA, 18 nt, Homo sapiens
ucugggcucaacuugacc

SEQ ID NO: 38978 - RNA, 22 nt, Homo sapiens
ugacaggauugacuaacuuuuc

SEQ ID NO: 38979 - RNA, 19 nt, Homo sapiens
ugggacucuucuaauaacc

SEQ ID NO: 38980 - RNA, 23 nt, Homo sapiens
aauuagggaagauauuaauguca

SEQ ID NO: 38981 - RNA, 20 nt, Homo sapiens
ccgcccgcucguccgcagcc

SEQ ID NO: 38982 - RNA, 22 nt, Homo sapiens
ccgccgccgccucggcuccagc

SEQ ID NO: 38983 - RNA, 22 nt, Homo sapiens
ccgccgccucggcuccagcucc

SEQ ID NO: 38984 - RNA, 22 nt, Homo sapiens
ccgccucggcuccagcuccggc

SEQ ID NO: 38985 - RNA, 15 nt, Homo sapiens
aaaaacagcuuuggu

SEQ ID NO: 38986 - RNA, 20 nt, Homo sapiens
aaaugguaggcucuucuaau

SEQ ID NO: 38987 - RNA, 20 nt, Homo sapiens
aacagauguuguaaucuuga

SEQ ID NO: 38988 - RNA, 20 nt, Homo sapiens
acugcugguuccauagcuuc

SEQ ID NO: 38989 - RNA, 15 nt, Homo sapiens
auauugcuauacuca

SEQ ID NO: 38990 - RNA, 22 nt, Homo sapiens
auggugguggugguggugaugg

SEQ ID NO: 38991 - RNA, 20 nt, Homo sapiens
cucaguguugucaacugaua

SEQ ID NO: 38992 - RNA, 21 nt, Homo sapiens
cugcuucuuuucuaggcuucu

SEQ ID NO: 38993 - RNA, 18 nt, Homo sapiens
cugugaccuucaaccaau

SEQ ID NO: 38994 - RNA, 19 nt, Homo sapiens
gcggggcgcucgcgccgcu

SEQ ID NO: 38995 - RNA, 19 nt, Homo sapiens
ggggggacaaaaagaaaaa

SEQ ID NO: 38996 - RNA, 18 nt, Homo sapiens
gguggugauggugguggu

SEQ ID NO: 38997 - RNA, 17 nt, Homo sapiens
uaaaaagcaggaaggga

SEQ ID NO: 38998 - RNA, 18 nt, Homo sapiens
uauaacacugugugaaga

SEQ ID NO: 38999 - RNA, 17 nt, Homo sapiens
uccaugcuguuuauguu

SEQ ID NO: 39000 - RNA, 21 nt, Homo sapiens
uccugucaugggggacucuuc

SEQ ID NO: 39001 - RNA, 19 nt, Homo sapiens
ucuaggcuucuuuugaucc

SEQ ID NO: 39002 - RNA, 22 nt, Homo sapiens
ugaaagguuguuucuugaacag

SEQ ID NO: 39003 - RNA, 21 nt, Homo sapiens
ugaugaugcaaugcauucugu

SEQ ID NO: 39004 - RNA, 16 nt, Homo sapiens
ugaugguggugguggu

SEQ ID NO: 39005 - RNA, 19 nt, Homo sapiens
ugauggugguggugguggu

SEQ ID NO: 39006 - RNA, 18 nt, Homo sapiens
uggauuuuaugauuuucu

SEQ ID NO: 39007 - RNA, 19 nt, Homo sapiens
ugguggagauaccacgugc

SEQ ID NO: 39008 - RNA, 25 nt, Homo sapiens
ugguggugauggugaugggccucug

SEQ ID NO: 39009 - RNA, 18 nt, Homo sapiens
ugucauggaguggugacu

SEQ ID NO: 39010 - RNA, 19 nt, Homo sapiens
uugguagaauuccaagugg

SEQ ID NO: 39011 - RNA, 16 nt, Homo sapiens
agcaaacuagaaaaga

SEQ ID NO: 39012 - RNA, 18 nt, Homo sapiens
cacagugggacugugagg

SEQ ID NO: 39013 - RNA, 19 nt, Homo sapiens
cagccgcgccagccgcgcc

SEQ ID NO: 39014 - RNA, 20 nt, Homo sapiens
cagcgccggggcccgccccc

SEQ ID NO: 39015 - RNA, 18 nt, Homo sapiens
ccgcccccucccgccccu

SEQ ID NO: 39016 - RNA, 25 nt, Homo sapiens
ccgcgcgugguuuguuuaccucucc

SEQ ID NO: 39017 - RNA, 15 nt, Homo sapiens
ccugccgccccagcc

SEQ ID NO: 39018 - RNA, 19 nt, Homo sapiens
cgggcgggccagcucggcc

SEQ ID NO: 39019 - RNA, 21 nt, Homo sapiens
cgugguuuguuuaccucuccc

SEQ ID NO: 39020 - RNA, 20 nt, Homo sapiens
gagcacgggggaggggcggg

SEQ ID NO: 39021 - RNA, 16 nt, Homo sapiens
gccagccgcgcccgcc

SEQ ID NO: 39022 - RNA, 21 nt, Homo sapiens
ggcgggcgggccagcucggcc

SEQ ID NO: 39023 - RNA, 19 nt, Homo sapiens
uagaggcugucaugcaugg

SEQ ID NO: 39024 - RNA, 18 nt, Homo sapiens
ugcgugcacaacucuucu

SEQ ID NO: 39025 - RNA, 21 nt, Homo sapiens
uguuuuaucauuaucaaaugc

SEQ ID NO: 39026 - RNA, 21 nt, Homo sapiens
accaggcccacuggccuggac

SEQ ID NO: 39027 - RNA, 16 nt, Homo sapiens
acggcggggguggcgg

SEQ ID NO: 39028 - RNA, 18 nt, Homo sapiens
auugaguuucccugcauu

SEQ ID NO: 39029 - RNA, 18 nt, Homo sapiens
ccaccuggucccgcuccc

SEQ ID NO: 39030 - RNA, 22 nt, Homo sapiens
cccugccccucagcaagcuggg

SEQ ID NO: 39031 - RNA, 17 nt, Homo sapiens
ccgccgccuccaccugg

SEQ ID NO: 39032 - RNA, 20 nt, Homo sapiens
ccgccgccuccaccuggucc

SEQ ID NO: 39033 - RNA, 19 nt, Homo sapiens
cugcucccacuccucugcc

SEQ ID NO: 39034 - RNA, 16 nt, Homo sapiens
cuggucccgcucccgc

SEQ ID NO: 39035 - RNA, 21 nt, Homo sapiens
gcuggagccgccgccucugcc

SEQ ID NO: 39036 - RNA, 19 nt, Homo sapiens
ggcggaggagaggggagcg

SEQ ID NO: 39037 - RNA, 19 nt, Homo sapiens
gggucugguggacagaagg

SEQ ID NO: 39038 - RNA, 19 nt, Homo sapiens
ucuaggcucucugauuggu

SEQ ID NO: 39039 - RNA, 19 nt, Homo sapiens
uggcccugaggugcauggg

SEQ ID NO: 39040 - RNA, 18 nt, Homo sapiens
aaaaauccaaaaaauuag

SEQ ID NO: 39041 - RNA, 16 nt, Homo sapiens
aggugggugcagaagc

SEQ ID NO: 39042 - RNA, 20 nt, Homo sapiens
ucgcggccugaggcaggagg

SEQ ID NO: 39043 - RNA, 23 nt, Homo sapiens
ugccuauaaucucagcacuuugg

SEQ ID NO: 39044 - RNA, 23 nt, Homo sapiens
ugcugaaacauuuuaggggcauu

SEQ ID NO: 39045 - RNA, 17 nt, Homo sapiens
uggccagguguaguggc

SEQ ID NO: 39046 - RNA, 17 nt, Homo sapiens
uugggaggcugaggugg

SEQ ID NO: 39047 - RNA, 18 nt, Homo sapiens
aaugauguaaacuuggau

SEQ ID NO: 39048 - RNA, 15 nt, Homo sapiens
caggaagauguuugg

SEQ ID NO: 39049 - RNA, 21 nt, Homo sapiens
gcucuugucccaccaguggac

SEQ ID NO: 39050 - RNA, 21 nt, Homo sapiens
ucuggugggcaaguuuuuggg

SEQ ID NO: 39051 - RNA, 18 nt, Homo sapiens
agacagccaaugacugcc

SEQ ID NO: 39052 - RNA, 18 nt, Homo sapiens
aggccagccccaggcugc

SEQ ID NO: 39053 - RNA, 21 nt, Homo sapiens
cccuugaaucucccagcuugg

SEQ ID NO: 39054 - RNA, 18 nt, Homo sapiens
gagaugaagucagcaccu

SEQ ID NO: 39055 - RNA, 16 nt, Homo sapiens
gcagccagguccuggg

SEQ ID NO: 39056 - RNA, 19 nt, Homo sapiens
gcuucagccugggguugcu

SEQ ID NO: 39057 - RNA, 17 nt, Homo sapiens
ggcagugcggcuggagc

SEQ ID NO: 39058 - RNA, 19 nt, Homo sapiens
ggccugugggcaccccggg

SEQ ID NO: 39059 - RNA, 22 nt, Homo sapiens
gugggggcuuccuccgagccgc

SEQ ID NO: 39060 - RNA, 19 nt, Homo sapiens
ugagcaggauauuuauaag

SEQ ID NO: 39061 - RNA, 18 nt, Homo sapiens
accgggcgcgcgcgggga

SEQ ID NO: 39062 - RNA, 16 nt, Homo sapiens
agagacaggccggggc

SEQ ID NO: 39063 - RNA, 18 nt, Homo sapiens
aucgaagucuccaccggg

SEQ ID NO: 39064 - RNA, 15 nt, Homo sapiens
ccgcgaggacagccc

SEQ ID NO: 39065 - RNA, 22 nt, Homo sapiens
ccgggcgcgcgcggggaguggg

SEQ ID NO: 39066 - RNA, 17 nt, Homo sapiens
gcgcggggagugggggg

SEQ ID NO: 39067 - RNA, 18 nt, Homo sapiens
ggcagaggggggcgcgcg

SEQ ID NO: 39068 - RNA, 19 nt, Homo sapiens
ggggagugggggggcgugg

SEQ ID NO: 39069 - RNA, 20 nt, Homo sapiens
uccaauucaucaguuuaucu

SEQ ID NO: 39070 - RNA, 16 nt, Homo sapiens
ucuugcccauacccag

SEQ ID NO: 39071 - RNA, 18 nt, Homo sapiens
ugcguagccccucuccau

SEQ ID NO: 39072 - RNA, 15 nt, Homo sapiens
uggccgcgccgcggc

SEQ ID NO: 39073 - RNA, 18 nt, Homo sapiens
cagucgcuccccagcgcg

SEQ ID NO: 39074 - RNA, 16 nt, Homo sapiens
gcuccgagcgggcgcc

SEQ ID NO: 39075 - RNA, 21 nt, Homo sapiens
cagggucccagcuucuccgcc

SEQ ID NO: 39076 - RNA, 20 nt, Homo sapiens
cauuuuacagagcgcugauu

SEQ ID NO: 39077 - RNA, 19 nt, Homo sapiens
ccagcaucagguuuucugu

SEQ ID NO: 39078 - RNA, 18 nt, Homo sapiens
ccccaagugccauuuucu

SEQ ID NO: 39079 - RNA, 19 nt, Homo sapiens
ccuaggcuggggcuugaac

SEQ ID NO: 39080 - RNA, 18 nt, Homo sapiens
gagugaucuuucaaaaau

SEQ ID NO: 39081 - RNA, 18 nt, Homo sapiens
gcuagguuggcugugcug

SEQ ID NO: 39082 - RNA, 19 nt, Homo sapiens
ggcuuuccuaggcuggggc

SEQ ID NO: 39083 - RNA, 21 nt, Homo sapiens
ucuaaaacauugcaacuacug

SEQ ID NO: 39084 - RNA, 22 nt, Homo sapiens
accagaucacuagcaaauucgu

SEQ ID NO: 39085 - RNA, 21 nt, Homo sapiens
agaccagccugggcaacauag

SEQ ID NO: 39086 - RNA, 18 nt, Homo sapiens
aggaacuagauauuacua

SEQ ID NO: 39087 - RNA, 19 nt, Homo sapiens
caacuaagcacuuggggaa

SEQ ID NO: 39088 - RNA, 20 nt, Homo sapiens
cagcacccugggcccgcggc

SEQ ID NO: 39089 - RNA, 16 nt, Homo sapiens
cagccugggcaacaua

SEQ ID NO: 39090 - RNA, 19 nt, Homo sapiens
ccauuuccacagcguccag

SEQ ID NO: 39091 - RNA, 19 nt, Homo sapiens
gaggcugggaacagcccag

SEQ ID NO: 39092 - RNA, 18 nt, Homo sapiens
gcagugagugucuggggu

SEQ ID NO: 39093 - RNA, 17 nt, Homo sapiens
uagcugggugugguggu

SEQ ID NO: 39094 - RNA, 20 nt, Homo sapiens
ucaucaacuauugguugaua

SEQ ID NO: 39095 - RNA, 19 nt, Homo sapiens
uccugggaggaaugaggga

SEQ ID NO: 39096 - RNA, 24 nt, Homo sapiens
ugagacccugucuacaaaaaauaa

SEQ ID NO: 39097 - RNA, 23 nt, Homo sapiens
uggaagagcacagaugaaagagg

SEQ ID NO: 39098 - RNA, 17 nt, Homo sapiens
uugggaggcugaggcgg

SEQ ID NO: 39099 - RNA, 17 nt, Homo sapiens
aagggagggagggggac

SEQ ID NO: 39100 - RNA, 20 nt, Homo sapiens
caggccguggcaccgccccc

SEQ ID NO: 39101 - RNA, 17 nt, Homo sapiens
cccuggccccucucccc

SEQ ID NO: 39102 - RNA, 17 nt, Homo sapiens
cgggcgggcgggcgggc

SEQ ID NO: 39103 - RNA, 17 nt, Homo sapiens
cuccgcccgcgguccgg

SEQ ID NO: 39104 - RNA, 21 nt, Homo sapiens
gagggagggggacucccccua

SEQ ID NO: 39105 - RNA, 17 nt, Homo sapiens
gcccccugccccucccc

SEQ ID NO: 39106 - RNA, 23 nt, Homo sapiens
ggcgggcgggcgggcuggcaggc

SEQ ID NO: 39107 - RNA, 20 nt, Homo sapiens
ggggagggcuggcuggcggg

SEQ ID NO: 39108 - RNA, 19 nt, Homo sapiens
uggcgggcgggcgggcggg

SEQ ID NO: 39109 - RNA, 15 nt, Homo sapiens
cacugucauccucac

SEQ ID NO: 39110 - RNA, 19 nt, Homo sapiens
ccgaggcccaccaaggggg

SEQ ID NO: 39111 - RNA, 18 nt, Homo sapiens
ccucgccgcgccgcgcag

SEQ ID NO: 39112 - RNA, 18 nt, Homo sapiens
cgcgcgcgucggggcccg

SEQ ID NO: 39113 - RNA, 20 nt, Homo sapiens
cuacucccucugggugucac

SEQ ID NO: 39114 - RNA, 20 nt, Homo sapiens
cuggccccccuaucgcccgc

SEQ ID NO: 39115 - RNA, 20 nt, Homo sapiens
gagggacauuuggaaggggc

SEQ ID NO: 39116 - RNA, 22 nt, Homo sapiens
gcugugcagggucccaggugcg

SEQ ID NO: 39117 - RNA, 17 nt, Homo sapiens
uuggcggggaugaggcc

SEQ ID NO: 39118 - RNA, 16 nt, Homo sapiens
ccccuacugggaaccc

SEQ ID NO: 39119 - RNA, 19 nt, Homo sapiens
gagugcgcguccuccccgc

SEQ ID NO: 39120 - RNA, 20 nt, Homo sapiens
agcugcaagcuccaauggcc

SEQ ID NO: 39121 - RNA, 18 nt, Homo sapiens
cagggccccugaccugcc

SEQ ID NO: 39122 - RNA, 18 nt, Homo sapiens
cauuuccccuuuccuggg

SEQ ID NO: 39123 - RNA, 21 nt, Homo sapiens
ccccccaggcugccuuagucc

SEQ ID NO: 39124 - RNA, 19 nt, Homo sapiens
cccgagagcccaggccugg

SEQ ID NO: 39125 - RNA, 19 nt, Homo sapiens
gaggguccugggccagccc

SEQ ID NO: 39126 - RNA, 19 nt, Homo sapiens
gcccguccuucugcccacc

SEQ ID NO: 39127 - RNA, 17 nt, Homo sapiens
caccauguugaacgucc

SEQ ID NO: 39128 - RNA, 18 nt, Homo sapiens
cccggccccgccccgccc

SEQ ID NO: 39129 - RNA, 16 nt, Homo sapiens
cgguggggaggcagca

SEQ ID NO: 39130 - RNA, 18 nt, Homo sapiens
gaggcgcugcugcgggga

SEQ ID NO: 39131 - RNA, 17 nt, Homo sapiens
gcgccgggaggaggcgc

SEQ ID NO: 39132 - RNA, 23 nt, Homo sapiens
ggggcuuuuuaauauuuugcuuu

SEQ ID NO: 39133 - RNA, 17 nt, Homo sapiens
guaaggacggauguaaa

SEQ ID NO: 39134 - RNA, 17 nt, Homo sapiens
uccgagggaagagggag

SEQ ID NO: 39135 - RNA, 19 nt, Homo sapiens
ucuuguagccccucaccau

SEQ ID NO: 39136 - RNA, 20 nt, Homo sapiens
uguacagaaaagcguuuucu

SEQ ID NO: 39137 - RNA, 17 nt, Homo sapiens
aaaccaugcaacacguu

SEQ ID NO: 39138 - RNA, 18 nt, Homo sapiens
aaaggaaaagaagucauu

SEQ ID NO: 39139 - RNA, 16 nt, Homo sapiens
aacacacaccacgggg

SEQ ID NO: 39140 - RNA, 17 nt, Homo sapiens
aagcaccccaaugagga

SEQ ID NO: 39141 - RNA, 19 nt, Homo sapiens
aauguuuuaaaauauuaug

SEQ ID NO: 39142 - RNA, 20 nt, Homo sapiens
acugugcccccggggcugua

SEQ ID NO: 39143 - RNA, 17 nt, Homo sapiens
agagauaacaacagacg

SEQ ID NO: 39144 - RNA, 18 nt, Homo sapiens
agagggaugcaaaagaga

SEQ ID NO: 39145 - RNA, 18 nt, Homo sapiens
agccacagugugaccugg

SEQ ID NO: 39146 - RNA, 20 nt, Homo sapiens
aggacacugugcucagagaa

SEQ ID NO: 39147 - RNA, 22 nt, Homo sapiens
aggaggcggcaggggaggcggg

SEQ ID NO: 39148 - RNA, 18 nt, Homo sapiens
aggcggcaggggaggcgg

SEQ ID NO: 39149 - RNA, 23 nt, Homo sapiens
agggguuguguaugacgaugauc

SEQ ID NO: 39150 - RNA, 22 nt, Homo sapiens
auauauacauauauauauauau

SEQ ID NO: 39151 - RNA, 22 nt, Homo sapiens
auauauauacauauauauauau

SEQ ID NO: 39152 - RNA, 22 nt, Homo sapiens
auauauauauacauauauauau

SEQ ID NO: 39153 - RNA, 22 nt, Homo sapiens
auauauauauauacauauauau

SEQ ID NO: 39154 - RNA, 22 nt, Homo sapiens
auauauauauauauacauauau

SEQ ID NO: 39155 - RNA, 22 nt, Homo sapiens
auauauauauguauauauauau

SEQ ID NO: 39156 - RNA, 20 nt, Homo sapiens
auauauauguauauauauau

SEQ ID NO: 39157 - RNA, 22 nt, Homo sapiens
auauauauguauauauauauau

SEQ ID NO: 39158 - RNA, 22 nt, Homo sapiens
auauauguauauauauauauau

SEQ ID NO: 39159 - RNA, 22 nt, Homo sapiens
auauguauauauauauguauau

SEQ ID NO: 39160 - RNA, 19 nt, Homo sapiens
auuggauaggagauucaga

SEQ ID NO: 39161 - RNA, 23 nt, Homo sapiens
cagacguuuuagucacucaccaa

SEQ ID NO: 39162 - RNA, 22 nt, Homo sapiens
cagcacacuuugagauggcuag

SEQ ID NO: 39163 - RNA, 19 nt, Homo sapiens
caggaaacacagcaaacug

SEQ ID NO: 39164 - RNA, 24 nt, Homo sapiens
cauauauauauauauacauauaua

SEQ ID NO: 39165 - RNA, 18 nt, Homo sapiens
cauuuccccugccuguga

SEQ ID NO: 39166 - RNA, 16 nt, Homo sapiens
ccacccaggagacaga

SEQ ID NO: 39167 - RNA, 22 nt, Homo sapiens
cccaaaguuugucuccuguaag

SEQ ID NO: 39168 - RNA, 17 nt, Homo sapiens
cccugccugugagaugg

SEQ ID NO: 39169 - RNA, 18 nt, Homo sapiens
ccgauggggugcgcccca

SEQ ID NO: 39170 - RNA, 20 nt, Homo sapiens
ccgcuuuagcuggguaucag

SEQ ID NO: 39171 - RNA, 18 nt, Homo sapiens
ccuggauucugcacacag

SEQ ID NO: 39172 - RNA, 17 nt, Homo sapiens
ccuggccucgguccccc

SEQ ID NO: 39173 - RNA, 22 nt, Homo sapiens
cgagaugggcuggaccucuggg

SEQ ID NO: 39174 - RNA, 14 nt, Homo sapiens
cggcgcacgccgcc

SEQ ID NO: 39175 - RNA, 24 nt, Homo sapiens
cggcggccccugccccgcagagcc

SEQ ID NO: 39176 - RNA, 25 nt, Homo sapiens
cgggcggugggcggcggccuccgcg

SEQ ID NO: 39177 - RNA, 19 nt, Homo sapiens
cgggcggugggcggcggcg

SEQ ID NO: 39178 - RNA, 18 nt, Homo sapiens
cuccccgggcuggaggug

SEQ ID NO: 39179 - RNA, 20 nt, Homo sapiens
gaauguauacuuaaaaauga

SEQ ID NO: 39180 - RNA, 18 nt, Homo sapiens
gacuaaggcggagccugg

SEQ ID NO: 39181 - RNA, 18 nt, Homo sapiens
gagauugguuguacaaca

SEQ ID NO: 39182 - RNA, 18 nt, Homo sapiens
gagcuccuggcauguggc

SEQ ID NO: 39183 - RNA, 21 nt, Homo sapiens
gaucugggcucacugcagccu

SEQ ID NO: 39184 - RNA, 14 nt, Homo sapiens
gccgccccgccccc

SEQ ID NO: 39185 - RNA, 17 nt, Homo sapiens
gcggcaggggaggcggg

SEQ ID NO: 39186 - RNA, 20 nt, Homo sapiens
gcggcaggggaggcgggugg

SEQ ID NO: 39187 - RNA, 18 nt, Homo sapiens
gcggcggcuuccccuucu

SEQ ID NO: 39188 - RNA, 18 nt, Homo sapiens
ggcagagcccuggguucu

SEQ ID NO: 39189 - RNA, 19 nt, Homo sapiens
ggcaggaggcggcagggga

SEQ ID NO: 39190 - RNA, 23 nt, Homo sapiens
ggcggcgggcggugggcggcggc

SEQ ID NO: 39191 - RNA, 24 nt, Homo sapiens
ggcggcgggcggugggcggcggcc

SEQ ID NO: 39192 - RNA, 22 nt, Homo sapiens
ggcggugggcggcggcggcuuc

SEQ ID NO: 39193 - RNA, 17 nt, Homo sapiens
ggcuguaaagucugucc

SEQ ID NO: 39194 - RNA, 22 nt, Homo sapiens
ggguaauucaaacacggcuacc

SEQ ID NO: 39195 - RNA, 17 nt, Homo sapiens
gucuuggcucauuuaaa

SEQ ID NO: 39196 - RNA, 20 nt, Homo sapiens
gugggaagggaggcuggggg

SEQ ID NO: 39197 - RNA, 18 nt, Homo sapiens
uaaauauauauauauaua

SEQ ID NO: 39198 - RNA, 20 nt, Homo sapiens
uacaauguucugcucccugu

SEQ ID NO: 39199 - RNA, 22 nt, Homo sapiens
uaccaugcucuccuacauggcc

SEQ ID NO: 39200 - RNA, 21 nt, Homo sapiens
uacugaagagccucaaccaau

SEQ ID NO: 39201 - RNA, 19 nt, Homo sapiens
uaggucacugcauacauga

SEQ ID NO: 39202 - RNA, 19 nt, Homo sapiens
uauacauauauauauaaac

SEQ ID NO: 39203 - RNA, 22 nt, Homo sapiens
uauauacauauauauauauaua

SEQ ID NO: 39204 - RNA, 25 nt, Homo sapiens
uauauauacauauauauauauauau

SEQ ID NO: 39205 - RNA, 22 nt, Homo sapiens
uauauauauacauauauauaua

SEQ ID NO: 39206 - RNA, 25 nt, Homo sapiens
uauauauauacauauauauauauau

SEQ ID NO: 39207 - RNA, 22 nt, Homo sapiens
uauauauauauacauauauaua

SEQ ID NO: 39208 - RNA, 24 nt, Homo sapiens
uauauauauauacauauauauaua

SEQ ID NO: 39209 - RNA, 22 nt, Homo sapiens
uauauauauauauacauauaua

SEQ ID NO: 39210 - RNA, 22 nt, Homo sapiens
uauauauauauauauacauaua

SEQ ID NO: 39211 - RNA, 24 nt, Homo sapiens
uauauauauauauauacauauaua

SEQ ID NO: 39212 - RNA, 19 nt, Homo sapiens
uauauauauauguauauau

SEQ ID NO: 39213 - RNA, 20 nt, Homo sapiens
uauauauauauguauauaua

SEQ ID NO: 39214 - RNA, 21 nt, Homo sapiens
uauauauauauguauauauau

SEQ ID NO: 39215 - RNA, 22 nt, Homo sapiens
uauauauauauguauauauaua

SEQ ID NO: 39216 - RNA, 23 nt, Homo sapiens
uauauauauauguauauauauau

SEQ ID NO: 39217 - RNA, 24 nt, Homo sapiens
uauauauauauguauauauauaua

SEQ ID NO: 39218 - RNA, 21 nt, Homo sapiens
uauauauauguauauauauau

SEQ ID NO: 39219 - RNA, 22 nt, Homo sapiens
uauauauauguauauauauaua

SEQ ID NO: 39220 - RNA, 24 nt, Homo sapiens
uauauauauguauauauauauaua

SEQ ID NO: 39221 - RNA, 19 nt, Homo sapiens
uauauauguauauauauau

SEQ ID NO: 39222 - RNA, 24 nt, Homo sapiens
uauauauguauauauauauauaua

SEQ ID NO: 39223 - RNA, 24 nt, Homo sapiens
uauauauguauauauauauguaua

SEQ ID NO: 39224 - RNA, 22 nt, Homo sapiens
uauauguauauauauauauaua

SEQ ID NO: 39225 - RNA, 22 nt, Homo sapiens
uauauguauauauauauguaua

SEQ ID NO: 39226 - RNA, 24 nt, Homo sapiens
uauauguauauauauauguauaua

SEQ ID NO: 39227 - RNA, 23 nt, Homo sapiens
uaucauauacucacaacaggaag

SEQ ID NO: 39228 - RNA, 22 nt, Homo sapiens
uaucuguaagccuauuugggug

SEQ ID NO: 39229 - RNA, 22 nt, Homo sapiens
uauguauauauauauguauaua

SEQ ID NO: 39230 - RNA, 24 nt, Homo sapiens
uauguauauauauauguauauaua

SEQ ID NO: 39231 - RNA, 19 nt, Homo sapiens
uccacaacacacaccacgg

SEQ ID NO: 39232 - RNA, 18 nt, Homo sapiens
uccaggguggaagcaaga

SEQ ID NO: 39233 - RNA, 20 nt, Homo sapiens
ucucuguguacucccaggca

SEQ ID NO: 39234 - RNA, 22 nt, Homo sapiens
ugaacuaccaugucaacauauu

SEQ ID NO: 39235 - RNA, 21 nt, Homo sapiens
ugaggaaaaagaucagguugu

SEQ ID NO: 39236 - RNA, 19 nt, Homo sapiens
ugcugggcaguuuagcaau

SEQ ID NO: 39237 - RNA, 16 nt, Homo sapiens
uggaaaguuucuaagc

SEQ ID NO: 39238 - RNA, 19 nt, Homo sapiens
uggcaaggauuucuuggau

SEQ ID NO: 39239 - RNA, 19 nt, Homo sapiens
uguaacauagcaauacaac

SEQ ID NO: 39240 - RNA, 20 nt, Homo sapiens
uguccugaaucaaagauuaa

SEQ ID NO: 39241 - RNA, 20 nt, Homo sapiens
uguuuguuaguuugucuguu

SEQ ID NO: 39242 - RNA, 18 nt, Homo sapiens
uuagaucagauucuuuug

SEQ ID NO: 39243 - RNA, 22 nt, Homo sapiens
uuaguauucauuuugcuaucuu

SEQ ID NO: 39244 - RNA, 19 nt, Homo sapiens
uuucuaggggcugggccuu

SEQ ID NO: 39245 - RNA, 19 nt, Homo sapiens
uuuguuaguuugucuguuu

SEQ ID NO: 39246 - RNA, 21 nt, Homo sapiens
acccucugaaacaggcugucu

SEQ ID NO: 39247 - RNA, 22 nt, Homo sapiens
caaugugauaggggucgagaaa

SEQ ID NO: 39248 - RNA, 18 nt, Homo sapiens
cgggcggugggcggcggc

SEQ ID NO: 39249 - RNA, 21 nt, Homo sapiens
cgggcggugggcggcggcuac

SEQ ID NO: 39250 - RNA, 19 nt, Homo sapiens
cugggcccaccccugcccc

SEQ ID NO: 39251 - RNA, 26 nt, Homo sapiens
ggcggcgggcggugggcggcggcggc

SEQ ID NO: 39252 - RNA, 17 nt, Homo sapiens
gucccccacaauuccgg

SEQ ID NO: 39253 - RNA, 22 nt, Homo sapiens
uauauauacauauauauauaua

SEQ ID NO: 39254 - RNA, 24 nt, Homo sapiens
uauauauauauauacauauauaua

SEQ ID NO: 39255 - RNA, 22 nt, Homo sapiens
uauauauauauauauacauaua

SEQ ID NO: 39256 - RNA, 22 nt, Homo sapiens
uauauauguauauauauauaua

SEQ ID NO: 39257 - RNA, 20 nt, Homo sapiens
uggcucuaggugagcgguuc

SEQ ID NO: 39258 - RNA, 19 nt, Homo sapiens
uuguaauaucaaaagauua

SEQ ID NO: 39259 - RNA, 17 nt, Homo sapiens
agaggagacaggaggaa

SEQ ID NO: 39260 - RNA, 25 nt, Homo sapiens
cuguuguuuugugugugugugugua

SEQ ID NO: 39261 - RNA, 17 nt, Homo sapiens
gaacaaaagacacaaag

SEQ ID NO: 39262 - RNA, 17 nt, Homo sapiens
ugcauagcucuagauua

SEQ ID NO: 39263 - RNA, 24 nt, Homo sapiens
uguguguguguugucucaucagua

SEQ ID NO: 39264 - RNA, 21 nt, Homo sapiens
uguguguguugucucaucagu

SEQ ID NO: 39265 - RNA, 20 nt, Homo sapiens
uuuacaagaacaauacugug

SEQ ID NO: 39266 - RNA, 18 nt, Homo sapiens
aacuacagacacaagaca

SEQ ID NO: 39267 - RNA, 17 nt, Homo sapiens
agagugagaaaacagca

SEQ ID NO: 39268 - RNA, 19 nt, Homo sapiens
agggaucacaacgaagcau

SEQ ID NO: 39269 - RNA, 18 nt, Homo sapiens
uacccaguaaggucaucu

SEQ ID NO: 39270 - RNA, 19 nt, Homo sapiens
ucuaccagcgcaucugugc

SEQ ID NO: 39271 - RNA, 19 nt, Homo sapiens
uuagaaucauuucugacuu

SEQ ID NO: 39272 - RNA, 22 nt, Homo sapiens
uagccuuuuccuugggagaaau

SEQ ID NO: 39273 - RNA, 21 nt, Homo sapiens
uuacuuuaauuguugaaauaa

SEQ ID NO: 39274 - RNA, 22 nt, Homo sapiens
aacaguguucuaaaggcuggcc

SEQ ID NO: 39275 - RNA, 18 nt, Homo sapiens
aagcugcauuuuuccugc

SEQ ID NO: 39276 - RNA, 20 nt, Homo sapiens
caccagucuagcugcuaccu

SEQ ID NO: 39277 - RNA, 16 nt, Homo sapiens
cacugaucacgugccu

SEQ ID NO: 39278 - RNA, 18 nt, Homo sapiens
cggcggauggcgggcgcc

SEQ ID NO: 39279 - RNA, 18 nt, Homo sapiens
gccgccuccgcccgccac

SEQ ID NO: 39280 - RNA, 19 nt, Homo sapiens
gcggauggcuacgcggcgg

SEQ ID NO: 39281 - RNA, 21 nt, Homo sapiens
ggcggauggcgggcgcccgcg

SEQ ID NO: 39282 - RNA, 19 nt, Homo sapiens
ggcggauggcuacgcggcg

SEQ ID NO: 39283 - RNA, 20 nt, Homo sapiens
ucgcccucgcccgccgccuc

SEQ ID NO: 39284 - RNA, 18 nt, Homo sapiens
ugaggagcuggugaauuc

SEQ ID NO: 39285 - RNA, 18 nt, Homo sapiens
uggaaaucaguaauguaa

SEQ ID NO: 39286 - RNA, 16 nt, Homo sapiens
uggcgggcgcccgcgc

SEQ ID NO: 39287 - RNA, 17 nt, Homo sapiens
uucgcugccgccaccgc

SEQ ID NO: 39288 - RNA, 24 nt, Homo sapiens
cucggucugcagcaggcacucggc

SEQ ID NO: 39289 - RNA, 18 nt, Homo sapiens
gcugcuuuacauuccuuu

SEQ ID NO: 39290 - RNA, 18 nt, Homo sapiens
gcuuccccgcagcgcccc

SEQ ID NO: 39291 - RNA, 23 nt, Homo sapiens
ucuggcagcccuccgugcuugcu

SEQ ID NO: 39292 - RNA, 18 nt, Homo sapiens
ccaaaauccaaguauaga

SEQ ID NO: 39293 - RNA, 18 nt, Homo sapiens
acuggaguugggacuggg

SEQ ID NO: 39294 - RNA, 24 nt, Homo sapiens
ccccaggccccuguccugcuuccc

SEQ ID NO: 39295 - RNA, 16 nt, Homo sapiens
gaguuggcccuggggu

SEQ ID NO: 39296 - RNA, 21 nt, Homo sapiens
gggccggcagggggaguuggc

SEQ ID NO: 39297 - RNA, 22 nt, Homo sapiens
uggccuguggggagggucaggg

SEQ ID NO: 39298 - RNA, 21 nt, Homo sapiens
uucugggcuggcugagggcgg

SEQ ID NO: 39299 - RNA, 23 nt, Homo sapiens
ggacuguggcgcugcaggcucga

SEQ ID NO: 39300 - RNA, 19 nt, Homo sapiens
caccauccccccacccccc

SEQ ID NO: 39301 - RNA, 18 nt, Homo sapiens
cugcagagacaauggagg

SEQ ID NO: 39302 - RNA, 19 nt, Homo sapiens
gcggccggggccggugggg

SEQ ID NO: 39303 - RNA, 22 nt, Homo sapiens
gcggccggggccgguggggggg

SEQ ID NO: 39304 - RNA, 20 nt, Homo sapiens
ggaggggcagaggcauccgg

SEQ ID NO: 39305 - RNA, 17 nt, Homo sapiens
ggggaggguccugcagg

SEQ ID NO: 39306 - RNA, 18 nt, Homo sapiens
caacccaggaaguccagc

SEQ ID NO: 39307 - RNA, 20 nt, Homo sapiens
cauuuuacagagcgcugauu

SEQ ID NO: 39308 - RNA, 17 nt, Homo sapiens
cgcacccucuccccucc

SEQ ID NO: 39309 - RNA, 20 nt, Homo sapiens
gacuguggggcugcaggaaa

SEQ ID NO: 39310 - RNA, 15 nt, Homo sapiens
uacagcacagggcac

SEQ ID NO: 39311 - RNA, 17 nt, Homo sapiens
ucgaggugggggccugu

SEQ ID NO: 39312 - RNA, 16 nt, Homo sapiens
ucucgggcugcagugc

SEQ ID NO: 39313 - RNA, 22 nt, Homo sapiens
ccuauaguaaugaaaauauaua

SEQ ID NO: 39314 - RNA, 19 nt, Homo sapiens
uauauaaauauauauacac

SEQ ID NO: 39315 - RNA, 20 nt, Homo sapiens
agcagggggaggggcagggg

SEQ ID NO: 39316 - RNA, 21 nt, Homo sapiens
cacugagggauuuuuauuugc

SEQ ID NO: 39317 - RNA, 16 nt, Homo sapiens
cagggggaggggcagg

SEQ ID NO: 39318 - RNA, 16 nt, Homo sapiens
gcacuggaagcucuga

SEQ ID NO: 39319 - RNA, 19 nt, Homo sapiens
ggccugagccgcacagccc

SEQ ID NO: 39320 - RNA, 17 nt, Homo sapiens
ggcgucuggauccccga

SEQ ID NO: 39321 - RNA, 24 nt, Homo sapiens
gggaggggcaggggaccuccuggg

SEQ ID NO: 39322 - RNA, 20 nt, Homo sapiens
ggucuggggagcagcaagag

SEQ ID NO: 39323 - RNA, 18 nt, Homo sapiens
guugcguguuuccgugug

SEQ ID NO: 39324 - RNA, 21 nt, Homo sapiens
ucgagggguugccccugcacc

SEQ ID NO: 39325 - RNA, 18 nt, Homo sapiens
uuugagcagggggagggg

SEQ ID NO: 39326 - RNA, 18 nt, Homo sapiens
cccgggggagggccugag

SEQ ID NO: 39327 - RNA, 15 nt, Homo sapiens
agagguagcaaaaua

SEQ ID NO: 39328 - RNA, 16 nt, Homo sapiens
cagggccuugcugggg

SEQ ID NO: 39329 - RNA, 19 nt, Homo sapiens
cccggaaagcagaggacgg

SEQ ID NO: 39330 - RNA, 26 nt, Homo sapiens
uggaaguacaucugcugagcucauac

SEQ ID NO: 39331 - RNA, 20 nt, Homo sapiens
aagcggaaaguguggugggg

SEQ ID NO: 39332 - RNA, 21 nt, Homo sapiens
agguuguguuuucuuuucauu

SEQ ID NO: 39333 - RNA, 21 nt, Homo sapiens
agugagcuuuucucucuugug

SEQ ID NO: 39334 - RNA, 18 nt, Homo sapiens
augugcagaaaggugggu

SEQ ID NO: 39335 - RNA, 19 nt, Homo sapiens
cagcugccuccuggguuca

SEQ ID NO: 39336 - RNA, 21 nt, Homo sapiens
gcagugagucgagaucgugcc

SEQ ID NO: 39337 - RNA, 21 nt, Homo sapiens
ugagucgagaucgugccacug

SEQ ID NO: 39338 - RNA, 23 nt, Homo sapiens
ugccuauaaucucagcacuuugg

SEQ ID NO: 39339 - RNA, 18 nt, Homo sapiens
ugugugcagccuggccag

SEQ ID NO: 39340 - RNA, 17 nt, Homo sapiens
uugggaggccaaggugg

SEQ ID NO: 39341 - RNA, 20 nt, Homo sapiens
ccucagccccguugcucucc

SEQ ID NO: 39342 - RNA, 17 nt, Homo sapiens
ucucuuguguccuucaa

SEQ ID NO: 39343 - RNA, 18 nt, Homo sapiens
aguagcuggcauuacagg

SEQ ID NO: 39344 - RNA, 19 nt, Homo sapiens
ggagugcaauggcgucauu

SEQ ID NO: 39345 - RNA, 15 nt, Homo sapiens
aaaggaaaaaggaaa

SEQ ID NO: 39346 - RNA, 19 nt, Homo sapiens
aacaucacaaacauuuacu

SEQ ID NO: 39347 - RNA, 15 nt, Homo sapiens
accagcugcccgcca

SEQ ID NO: 39348 - RNA, 21 nt, Homo sapiens
accccaccccgucuuguuccc

SEQ ID NO: 39349 - RNA, 18 nt, Homo sapiens
agcacacgaagcaccagc

SEQ ID NO: 39350 - RNA, 15 nt, Homo sapiens
agccacacccacggc

SEQ ID NO: 39351 - RNA, 18 nt, Homo sapiens
aggaaaccacggaguccu

SEQ ID NO: 39352 - RNA, 21 nt, Homo sapiens
agugcagcuucuucccagccc

SEQ ID NO: 39353 - RNA, 18 nt, Homo sapiens
auucugaagcaaauccca

SEQ ID NO: 39354 - RNA, 18 nt, Homo sapiens
caacauucuucagacaga

SEQ ID NO: 39355 - RNA, 20 nt, Homo sapiens
cacuggagagccaccucccc

SEQ ID NO: 39356 - RNA, 18 nt, Homo sapiens
caggguccuucacagagc

SEQ ID NO: 39357 - RNA, 22 nt, Homo sapiens
ccgcccagguugccuagguccc

SEQ ID NO: 39358 - RNA, 20 nt, Homo sapiens
ccggccugaggacggacagc

SEQ ID NO: 39359 - RNA, 20 nt, Homo sapiens
ccuccgggaaagcccaaggc

SEQ ID NO: 39360 - RNA, 20 nt, Homo sapiens
ccucguuuucuucuuggucu

SEQ ID NO: 39361 - RNA, 20 nt, Homo sapiens
ccucuuggcgaccaggcccc

SEQ ID NO: 39362 - RNA, 19 nt, Homo sapiens
ccuggcggcucgagcuggg

SEQ ID NO: 39363 - RNA, 15 nt, Homo sapiens
cgagcuggguccucc

SEQ ID NO: 39364 - RNA, 20 nt, Homo sapiens
gaggcgcucccucccgagga

SEQ ID NO: 39365 - RNA, 19 nt, Homo sapiens
gcaucaguaaacacacacu

SEQ ID NO: 39366 - RNA, 21 nt, Homo sapiens
gccggccugaggacggacagc

SEQ ID NO: 39367 - RNA, 19 nt, Homo sapiens
gccuggcuggggaggccca

SEQ ID NO: 39368 - RNA, 19 nt, Homo sapiens
gcgagugccccucagaggc

SEQ ID NO: 39369 - RNA, 19 nt, Homo sapiens
gcucccucccgaggaggcc

SEQ ID NO: 39370 - RNA, 26 nt, Homo sapiens
ggaaaccaaaacuaccuccgaacaaa

SEQ ID NO: 39371 - RNA, 21 nt, Homo sapiens
ggcagcucacacagcugugga

SEQ ID NO: 39372 - RNA, 18 nt, Homo sapiens
ggcugugacaccccgugg

SEQ ID NO: 39373 - RNA, 24 nt, Homo sapiens
gguuuagaugucaagacagacaaa

SEQ ID NO: 39374 - RNA, 18 nt, Homo sapiens
gugcagaugaugcuguug

SEQ ID NO: 39375 - RNA, 20 nt, Homo sapiens
guggaucacgaggucaggag

SEQ ID NO: 39376 - RNA, 23 nt, Homo sapiens
uaaguuaauaucugcuccccaaa

SEQ ID NO: 39377 - RNA, 15 nt, Homo sapiens
uacaaugauggcagg

SEQ ID NO: 39378 - RNA, 15 nt, Homo sapiens
uaggaugagcccacu

SEQ ID NO: 39379 - RNA, 19 nt, Homo sapiens
uaugugcacuaccugaaga

SEQ ID NO: 39380 - RNA, 20 nt, Homo sapiens
ucacaggagaguggguguca

SEQ ID NO: 39381 - RNA, 18 nt, Homo sapiens
ucacccucugccuuucac

SEQ ID NO: 39382 - RNA, 21 nt, Homo sapiens
uccaucaccagacccacagag

SEQ ID NO: 39383 - RNA, 19 nt, Homo sapiens
ucgcaugguacugugaaua

SEQ ID NO: 39384 - RNA, 20 nt, Homo sapiens
ucgcucuccuguguuucucg

SEQ ID NO: 39385 - RNA, 21 nt, Homo sapiens
ugaagaguuucccccacaggu

SEQ ID NO: 39386 - RNA, 23 nt, Homo sapiens
ugagcuccgagcagcuuagcucc

SEQ ID NO: 39387 - RNA, 18 nt, Homo sapiens
ugagcugggcucagacgg

SEQ ID NO: 39388 - RNA, 18 nt, Homo sapiens
ugaggguagcgacgcuga

SEQ ID NO: 39389 - RNA, 21 nt, Homo sapiens
ugcagaugaugcuguuggagg

SEQ ID NO: 39390 - RNA, 21 nt, Homo sapiens
ugcaguggcucacaccugcaa

SEQ ID NO: 39391 - RNA, 23 nt, Homo sapiens
ugccuguaaucccagcacuuugg

SEQ ID NO: 39392 - RNA, 17 nt, Homo sapiens
uggcucuggggggggcu

SEQ ID NO: 39393 - RNA, 20 nt, Homo sapiens
ugggacugucccucucacug

SEQ ID NO: 39394 - RNA, 24 nt, Homo sapiens
uguccgagaccugcagcagcaucc

SEQ ID NO: 39395 - RNA, 17 nt, Homo sapiens
uguccgagaccuugguc

SEQ ID NO: 39396 - RNA, 17 nt, Homo sapiens
uucaaauccaacuugac

SEQ ID NO: 39397 - RNA, 19 nt, Homo sapiens
uucacaacuugaauacgac

SEQ ID NO: 39398 - RNA, 23 nt, Homo sapiens
uucucaggagcacuuucuuauca

SEQ ID NO: 39399 - RNA, 23 nt, Homo sapiens
uuggagagacacccugcuguaag

SEQ ID NO: 39400 - RNA, 18 nt, Homo sapiens
caggguccuucacagagc

SEQ ID NO: 39401 - RNA, 18 nt, Homo sapiens
ccgagaccugcagcagca

SEQ ID NO: 39402 - RNA, 22 nt, Homo sapiens
cguugcuguaaaauaauuuugg

SEQ ID NO: 39403 - RNA, 21 nt, Homo sapiens
cuaauuacagucaauuugaca

SEQ ID NO: 39404 - RNA, 17 nt, Homo sapiens
ggaaccaaggaggcgga

SEQ ID NO: 39405 - RNA, 14 nt, Homo sapiens
ucuuaaccggcgau

SEQ ID NO: 39406 - RNA, 21 nt, Homo sapiens
ugacagacccagcacuuguuc

SEQ ID NO: 39407 - RNA, 22 nt, Homo sapiens
ugugugcguguguauaaaaagu

SEQ ID NO: 39408 - RNA, 20 nt, Homo sapiens
agauuuccucuuuuucucgc

SEQ ID NO: 39409 - RNA, 19 nt, Homo sapiens
cacucuuguacuugaauac

SEQ ID NO: 39410 - RNA, 18 nt, Homo sapiens
gaaacaaaaaugaagcug

SEQ ID NO: 39411 - RNA, 21 nt, Homo sapiens
gcggucagggcgcgcggccgg

SEQ ID NO: 39412 - RNA, 14 nt, Homo sapiens
ucagggcgcgcggc

SEQ ID NO: 39413 - RNA, 21 nt, Homo sapiens
ucuaauguagaaggcccauuu

SEQ ID NO: 39414 - RNA, 18 nt, Homo sapiens
ucucgcuggaaaucugcu

SEQ ID NO: 39415 - RNA, 20 nt, Homo sapiens
aagcugcaaaacuuuauuga

SEQ ID NO: 39416 - RNA, 21 nt, Homo sapiens
gugagguucccucgugccuua

SEQ ID NO: 39417 - RNA, 19 nt, Homo sapiens
gugguucuguguuugugug

SEQ ID NO: 39418 - RNA, 20 nt, Homo sapiens
gugguucuguguuugugugu

SEQ ID NO: 39419 - RNA, 25 nt, Homo sapiens
uuggugaaagcugcaaaacuuuauu

SEQ ID NO: 39420 - RNA, 21 nt, Homo sapiens
caggagauguuacuuuuccaa

SEQ ID NO: 39421 - RNA, 21 nt, Homo sapiens
gaggugcagauagcuugcuuu

SEQ ID NO: 39422 - RNA, 16 nt, Homo sapiens
uauacaguauguacau

SEQ ID NO: 39423 - RNA, 16 nt, Homo sapiens
uugaggcacaaagauu

SEQ ID NO: 39424 - RNA, 20 nt, Homo sapiens
uuugucaugauaauuuugug

SEQ ID NO: 39425 - RNA, 20 nt, Homo sapiens
agagcuacgcgcuccagggc

SEQ ID NO: 39426 - RNA, 17 nt, Homo sapiens
agcaauucuccugggau

SEQ ID NO: 39427 - RNA, 21 nt, Homo sapiens
uccucaaaagacuacugcaga

SEQ ID NO: 39428 - RNA, 22 nt, Homo sapiens
uccuuacggggugggaccggcc

SEQ ID NO: 39429 - RNA, 20 nt, Homo sapiens
gagcucacagcugaauucca

SEQ ID NO: 39430 - RNA, 17 nt, Homo sapiens
gauuguuugugccaagc

SEQ ID NO: 39431 - RNA, 16 nt, Homo sapiens
ucugaaccauguccag

SEQ ID NO: 39432 - RNA, 21 nt, Homo sapiens
uggaaacauccaucagcucau

SEQ ID NO: 39433 - RNA, 24 nt, Homo sapiens
uggcuuccagauuguuugugccaa

SEQ ID NO: 39434 - RNA, 17 nt, Homo sapiens
cccgccccauugggucc

SEQ ID NO: 39435 - RNA, 16 nt, Homo sapiens
ccugcggaucacgugg

SEQ ID NO: 39436 - RNA, 19 nt, Homo sapiens
gagcaggccuugacucugu

SEQ ID NO: 39437 - RNA, 19 nt, Homo sapiens
ggaucguguacaaauguau

SEQ ID NO: 39438 - RNA, 18 nt, Homo sapiens
ggauugauggugaagcca

SEQ ID NO: 39439 - RNA, 17 nt, Homo sapiens
ggggcugcccgccgggg

SEQ ID NO: 39440 - RNA, 20 nt, Homo sapiens
ucggcuguacugcugaaccc

SEQ ID NO: 39441 - RNA, 25 nt, Homo sapiens
ugauggauuuaucaacagcuguauc

SEQ ID NO: 39442 - RNA, 20 nt, Homo sapiens
aauacagagcuaguguuugg

SEQ ID NO: 39443 - RNA, 23 nt, Homo sapiens
aucucccaguacuggaccggguu

SEQ ID NO: 39444 - RNA, 15 nt, Homo sapiens
ccgaguugaauggca

SEQ ID NO: 39445 - RNA, 18 nt, Homo sapiens
ggugcugcucugugacua

SEQ ID NO: 39446 - RNA, 18 nt, Homo sapiens
uaaaacauccacauugca

SEQ ID NO: 39447 - RNA, 19 nt, Homo sapiens
uaagaauaucucuaguagc

SEQ ID NO: 39448 - RNA, 17 nt, Homo sapiens
acucuuucccaauauuu

SEQ ID NO: 39449 - RNA, 19 nt, Homo sapiens
agcaguacgguccuguuuu

SEQ ID NO: 39450 - RNA, 17 nt, Homo sapiens
gcccgcuucggccuccc

SEQ ID NO: 39451 - RNA, 19 nt, Homo sapiens
uaaugugguuaaaccgcuu

SEQ ID NO: 39452 - RNA, 15 nt, Homo sapiens
uagcagagaacgaug

SEQ ID NO: 39453 - RNA, 19 nt, Homo sapiens
uaucaaaucagcuuaugau

SEQ ID NO: 39454 - RNA, 21 nt, Homo sapiens
uauuuuguuucuguggcagaa

SEQ ID NO: 39455 - RNA, 19 nt, Homo sapiens
uccaagcaguacgguccug

SEQ ID NO: 39456 - RNA, 21 nt, Homo sapiens
ugggaggagggggaaauagga

SEQ ID NO: 39457 - RNA, 18 nt, Homo sapiens
acgcagcaacggcaccag

SEQ ID NO: 39458 - RNA, 24 nt, Homo sapiens
ccuccccgcuuuccuuucguuugu

SEQ ID NO: 39459 - RNA, 23 nt, Homo sapiens
gaaguuugaucuugaaaaucucu

SEQ ID NO: 39460 - RNA, 19 nt, Homo sapiens
gcggaaggcgagauugagg

SEQ ID NO: 39461 - RNA, 22 nt, Homo sapiens
gcugacuguuguuggugaaugu

SEQ ID NO: 39462 - RNA, 18 nt, Homo sapiens
ggcggcugaggcggcggc

SEQ ID NO: 39463 - RNA, 21 nt, Homo sapiens
gggaaaguuggagguggggga

SEQ ID NO: 39464 - RNA, 18 nt, Homo sapiens
gggggcgcgcggggcuac

SEQ ID NO: 39465 - RNA, 16 nt, Homo sapiens
ggggggaggagaggag

SEQ ID NO: 39466 - RNA, 16 nt, Homo sapiens
ccugcucccucgaugg

SEQ ID NO: 39467 - RNA, 19 nt, Homo sapiens
cgccaugcgccggccgccu

SEQ ID NO: 39468 - RNA, 18 nt, Homo sapiens
cgcgcugccgcuuccggg

SEQ ID NO: 39469 - RNA, 21 nt, Homo sapiens
gcauccucuuucgccuguggu

SEQ ID NO: 39470 - RNA, 22 nt, Homo sapiens
gccagacacgccaugcgccggc

SEQ ID NO: 39471 - RNA, 15 nt, Homo sapiens
gccgggucgcgccgc

SEQ ID NO: 39472 - RNA, 21 nt, Homo sapiens
gcgccgcgcugccgcuuccgg

SEQ ID NO: 39473 - RNA, 18 nt, Homo sapiens
ggagcuccugcagcacau

SEQ ID NO: 39474 - RNA, 21 nt, Homo sapiens
uccgcccgcccgggauccgcc

SEQ ID NO: 39475 - RNA, 17 nt, Homo sapiens
uggaggaggcgggaagc

SEQ ID NO: 39476 - RNA, 22 nt, Homo sapiens
aggcagaagcgcaguagugccg

SEQ ID NO: 39477 - RNA, 25 nt, Homo sapiens
aggcagaagcgcaguagugcgagac

SEQ ID NO: 39478 - RNA, 18 nt, Homo sapiens
augacaaugacuagacaa

SEQ ID NO: 39479 - RNA, 25 nt, Homo sapiens
augauauucauaaaaugacaaaaaa

SEQ ID NO: 39480 - RNA, 23 nt, Homo sapiens
cagcagcaggaccgcggacacuc

SEQ ID NO: 39481 - RNA, 19 nt, Homo sapiens
caucgcccucggccccucg

SEQ ID NO: 39482 - RNA, 21 nt, Homo sapiens
cgagcgccgcugcgagggcag

SEQ ID NO: 39483 - RNA, 19 nt, Homo sapiens
cugauugcacugaacauuu

SEQ ID NO: 39484 - RNA, 19 nt, Homo sapiens
gccacaacaaacuuaaacc

SEQ ID NO: 39485 - RNA, 18 nt, Homo sapiens
ggcaggcgcggcggcggc

SEQ ID NO: 39486 - RNA, 21 nt, Homo sapiens
gugauugugcuuuuaaaacca

SEQ ID NO: 39487 - RNA, 18 nt, Homo sapiens
ucgcccucggccccucgc

SEQ ID NO: 39488 - RNA, 16 nt, Homo sapiens
ucuugcggagccuccc

SEQ ID NO: 39489 - RNA, 21 nt, Homo sapiens
ucuuguagguuucgacauugg

SEQ ID NO: 39490 - RNA, 16 nt, Homo sapiens
uggggucagaccugau

SEQ ID NO: 39491 - RNA, 16 nt, Homo sapiens
uguuucuaccccauuc

SEQ ID NO: 39492 - RNA, 22 nt, Homo sapiens
uguuuggcuuuguuuuccacug

SEQ ID NO: 39493 - RNA, 18 nt, Homo sapiens
uuggucauuaaaaacauc

SEQ ID NO: 39494 - RNA, 18 nt, Homo sapiens
gaguaaccuaccaauacc

SEQ ID NO: 39495 - RNA, 20 nt, Homo sapiens
guggaacagaauggguacag

SEQ ID NO: 39496 - RNA, 18 nt, Homo sapiens
ucuuggccucaggacccc

SEQ ID NO: 39497 - RNA, 19 nt, Homo sapiens
aagcugagggacuguuggg

SEQ ID NO: 39498 - RNA, 18 nt, Homo sapiens
acagcugcucugugcagg

SEQ ID NO: 39499 - RNA, 16 nt, Homo sapiens
accaaagauucccuca

SEQ ID NO: 39500 - RNA, 16 nt, Homo sapiens
caaagggcugccucag

SEQ ID NO: 39501 - RNA, 15 nt, Homo sapiens
caaggcaggcaggcu

SEQ ID NO: 39502 - RNA, 19 nt, Homo sapiens
cacggccuggcccucccgc

SEQ ID NO: 39503 - RNA, 20 nt, Homo sapiens
ccccuccagcucaaacgguc

SEQ ID NO: 39504 - RNA, 17 nt, Homo sapiens
gagggacuguuggggga

SEQ ID NO: 39505 - RNA, 18 nt, Homo sapiens
gccugcgggaggggacac

SEQ ID NO: 39506 - RNA, 19 nt, Homo sapiens
gcuuucaaggccauucccu

SEQ ID NO: 39507 - RNA, 19 nt, Homo sapiens
gggacccagcacggggccu

SEQ ID NO: 39508 - RNA, 25 nt, Homo sapiens
ucccgcgucucucccacggccuggc

SEQ ID NO: 39509 - RNA, 16 nt, Homo sapiens
ugaugacucggaauga

SEQ ID NO: 39510 - RNA, 17 nt, Homo sapiens
ugcaaaaaaguggcggu

SEQ ID NO: 39511 - RNA, 15 nt, Homo sapiens
ugcgcccugcucugc

SEQ ID NO: 39512 - RNA, 22 nt, Homo sapiens
uggcucuggauaucuguggcuc

SEQ ID NO: 39513 - RNA, 19 nt, Homo sapiens
uagaggcagcugauuuucc

SEQ ID NO: 39514 - RNA, 17 nt, Homo sapiens
uggcgcggcggcgccgc

SEQ ID NO: 39515 - RNA, 17 nt, Homo sapiens
augugcaguguguggcg

SEQ ID NO: 39516 - RNA, 18 nt, Homo sapiens
ggagagcgcagggagagc

SEQ ID NO: 39517 - RNA, 20 nt, Homo sapiens
uccagaaacuggggcugugc

SEQ ID NO: 39518 - RNA, 20 nt, Homo sapiens
ugauggggaggaguaugggg

SEQ ID NO: 39519 - RNA, 17 nt, Homo sapiens
uggagaaugauggggag

SEQ ID NO: 39520 - RNA, 18 nt, Homo sapiens
aggcaggagacggugccc

SEQ ID NO: 39521 - RNA, 19 nt, Homo sapiens
cgggcgggcaggcuagaca

SEQ ID NO: 39522 - RNA, 28 nt, Homo sapiens
gccaugcgggcgggcaggcuagacauuc

SEQ ID NO: 39523 - RNA, 21 nt, Homo sapiens
gcccgcucagcaaccgucccc

SEQ ID NO: 39524 - RNA, 18 nt, Homo sapiens
uggcgucgcaggugguug

SEQ ID NO: 39525 - RNA, 19 nt, Homo sapiens
cacaguggccggcugggug

SEQ ID NO: 39526 - RNA, 16 nt, Homo sapiens
cagccgacgagcuagg

SEQ ID NO: 39527 - RNA, 18 nt, Homo sapiens
caguggccggcugggugg

SEQ ID NO: 39528 - RNA, 19 nt, Homo sapiens
caugacacacaguggccgg

SEQ ID NO: 39529 - RNA, 17 nt, Homo sapiens
ccgucccgccuccuucc

SEQ ID NO: 39530 - RNA, 18 nt, Homo sapiens
cugcagcaguaaaaaccg

SEQ ID NO: 39531 - RNA, 21 nt, Homo sapiens
gcaccaccagcuccugcagag

SEQ ID NO: 39532 - RNA, 16 nt, Homo sapiens
gccgguagggcccgcc

SEQ ID NO: 39533 - RNA, 22 nt, Homo sapiens
ggacaugcguacuagcggaggg

SEQ ID NO: 39534 - RNA, 15 nt, Homo sapiens
gggguagcagcugcu

SEQ ID NO: 39535 - RNA, 16 nt, Homo sapiens
ggguaccagagcugcg

SEQ ID NO: 39536 - RNA, 18 nt, Homo sapiens
uacaugagcccagaggca

SEQ ID NO: 39537 - RNA, 15 nt, Homo sapiens
uccaugaguccagcu

SEQ ID NO: 39538 - RNA, 16 nt, Homo sapiens
ugaggacacggcagca

SEQ ID NO: 39539 - RNA, 21 nt, Homo sapiens
ugaguccagcuggggcuucac

SEQ ID NO: 39540 - RNA, 16 nt, Homo sapiens
caccaggcacuggcag

SEQ ID NO: 39541 - RNA, 15 nt, Homo sapiens
caccgggccgggcag

SEQ ID NO: 39542 - RNA, 18 nt, Homo sapiens
cagcugcugcgccggccc

SEQ ID NO: 39543 - RNA, 18 nt, Homo sapiens
cccaggcccggggcccgg

SEQ ID NO: 39544 - RNA, 18 nt, Homo sapiens
ccgcagcugcugcgccgg

SEQ ID NO: 39545 - RNA, 19 nt, Homo sapiens
cgcgaccggggaagguggc

SEQ ID NO: 39546 - RNA, 16 nt, Homo sapiens
cggcgccggcggcggc

SEQ ID NO: 39547 - RNA, 19 nt, Homo sapiens
gccaggcucagggggcugc

SEQ ID NO: 39548 - RNA, 19 nt, Homo sapiens
ggcggcuggcggcggcgac

SEQ ID NO: 39549 - RNA, 17 nt, Homo sapiens
ucaguccgcccguccgc

SEQ ID NO: 39550 - RNA, 23 nt, Homo sapiens
ugagaacgcugccagaggccagc

SEQ ID NO: 39551 - RNA, 18 nt, Homo sapiens
ugggaggaucaucacggc

SEQ ID NO: 39552 - RNA, 21 nt, Homo sapiens
aagugggaaaacggcagacag

SEQ ID NO: 39553 - RNA, 18 nt, Homo sapiens
auccucuugauaagguuc

SEQ ID NO: 39554 - RNA, 16 nt, Homo sapiens
auguagacaauugcug

SEQ ID NO: 39555 - RNA, 18 nt, Homo sapiens
cacaccugaaauggggaa

SEQ ID NO: 39556 - RNA, 21 nt, Homo sapiens
cagcccucuucagcugcagug

SEQ ID NO: 39557 - RNA, 17 nt, Homo sapiens
cggugcacacagggagc

SEQ ID NO: 39558 - RNA, 19 nt, Homo sapiens
cugcagcugcuucugccgg

SEQ ID NO: 39559 - RNA, 18 nt, Homo sapiens
gagaggagggugcugucu

SEQ ID NO: 39560 - RNA, 17 nt, Homo sapiens
ggcggcggcgaggacgg

SEQ ID NO: 39561 - RNA, 17 nt, Homo sapiens
uagagugauggacaagc

SEQ ID NO: 39562 - RNA, 26 nt, Homo sapiens
uccacguucagacuuggccacuguau

SEQ ID NO: 39563 - RNA, 22 nt, Homo sapiens
ugucagaggucugggcuggguc

SEQ ID NO: 39564 - RNA, 19 nt, Homo sapiens
uucguggucuuagaugauu

SEQ ID NO: 39565 - RNA, 18 nt, Homo sapiens
ccugucgugauccacagu

SEQ ID NO: 39566 - RNA, 18 nt, Homo sapiens
cugguugaccugcgccuc

SEQ ID NO: 39567 - RNA, 18 nt, Homo sapiens
uggauugauacaaaguag

SEQ ID NO: 39568 - RNA, 21 nt, Homo sapiens
gcacugaguggggagcgggcc

SEQ ID NO: 39569 - RNA, 18 nt, Homo sapiens
acagaaaauuuuuagaag

SEQ ID NO: 39570 - RNA, 20 nt, Homo sapiens
agcaaauguaugaguaauaa

SEQ ID NO: 39571 - RNA, 21 nt, Homo sapiens
ccuugagcucagcaaucccag

SEQ ID NO: 39572 - RNA, 22 nt, Homo sapiens
gagugugcaugucauauuauaa

SEQ ID NO: 39573 - RNA, 14 nt, Homo sapiens
gcagcacaccaaca

SEQ ID NO: 39574 - RNA, 15 nt, Homo sapiens
gcagcacaccaacag

SEQ ID NO: 39575 - RNA, 23 nt, Homo sapiens
gggcgcaggucagugggugcgcg

SEQ ID NO: 39576 - RNA, 22 nt, Homo sapiens
ggggaaggggggagggauagca

SEQ ID NO: 39577 - RNA, 18 nt, Homo sapiens
ggugggggaaggggggag

SEQ ID NO: 39578 - RNA, 21 nt, Homo sapiens
ucaagcaaacaaaaaaauaug

SEQ ID NO: 39579 - RNA, 18 nt, Homo sapiens
ucacacaccagggccugu

SEQ ID NO: 39580 - RNA, 20 nt, Homo sapiens
ucuuuagggggcuguuauug

SEQ ID NO: 39581 - RNA, 17 nt, Homo sapiens
acaaacacuuuugaaag

SEQ ID NO: 39582 - RNA, 23 nt, Homo sapiens
aguugaacaaaaggcagggguga

SEQ ID NO: 39583 - RNA, 19 nt, Homo sapiens
uaacacaaucugaacuuuc

SEQ ID NO: 39584 - RNA, 18 nt, Homo sapiens
ugaaauauuuaacuaggc

SEQ ID NO: 39585 - RNA, 18 nt, Homo sapiens
ugaauauguucagauguc

SEQ ID NO: 39586 - RNA, 18 nt, Homo sapiens
ugaggucgacaacugccc

SEQ ID NO: 39587 - RNA, 17 nt, Homo sapiens
uggcguauaugggucau

SEQ ID NO: 39588 - RNA, 23 nt, Homo sapiens
uggugauucuuaucuggucgugg

SEQ ID NO: 39589 - RNA, 21 nt, Homo sapiens
cccguuccacaacaagguccc

SEQ ID NO: 39590 - RNA, 18 nt, Homo sapiens
uaauucugaaggacugcu

SEQ ID NO: 39591 - RNA, 17 nt, Homo sapiens
ucagcaaaaucuagcaa

SEQ ID NO: 39592 - RNA, 22 nt, Homo sapiens
ucuaagaauugaugggaccuaa

SEQ ID NO: 39593 - RNA, 17 nt, Homo sapiens
uguuguagcugugguaa

SEQ ID NO: 39594 - RNA, 21 nt, Homo sapiens
aucacuuugcuuuauuugaca

SEQ ID NO: 39595 - RNA, 20 nt, Homo sapiens
cgucacugcuuucguucacg

SEQ ID NO: 39596 - RNA, 18 nt, Homo sapiens
gaggcagguguuggaaca

SEQ ID NO: 39597 - RNA, 19 nt, Homo sapiens
uaagaauuuaguacuaacu

SEQ ID NO: 39598 - RNA, 19 nt, Homo sapiens
auauaucacaguucuuugu

SEQ ID NO: 39599 - RNA, 22 nt, Homo sapiens
aauuauuucagcacauauaacu

SEQ ID NO: 39600 - RNA, 19 nt, Homo sapiens
acaaaaguauuucauaacu

SEQ ID NO: 39601 - RNA, 15 nt, Homo sapiens
aggggcguggaucca

SEQ ID NO: 39602 - RNA, 22 nt, Homo sapiens
aguaaaacuaauauggaagauu

SEQ ID NO: 39603 - RNA, 20 nt, Homo sapiens
agugggggagaggggcgugg

SEQ ID NO: 39604 - RNA, 22 nt, Homo sapiens
caucaugggaaagugggggaga

SEQ ID NO: 39605 - RNA, 22 nt, Homo sapiens
caugugcacaaggaaucaaaua

SEQ ID NO: 39606 - RNA, 18 nt, Homo sapiens
ccaaguuuuauuucaaac

SEQ ID NO: 39607 - RNA, 18 nt, Homo sapiens
cuguagcugcugcuggaa

SEQ ID NO: 39608 - RNA, 20 nt, Homo sapiens
gaccuguuguccacaagcag

SEQ ID NO: 39609 - RNA, 22 nt, Homo sapiens
uaacccucaguuucuaacuuuc

SEQ ID NO: 39610 - RNA, 16 nt, Homo sapiens
uaccacugccaccgcc

SEQ ID NO: 39611 - RNA, 20 nt, Homo sapiens
ucauacuugaaugcuuuucu

SEQ ID NO: 39612 - RNA, 18 nt, Homo sapiens
ucguggaggagaacuugu

SEQ ID NO: 39613 - RNA, 20 nt, Homo sapiens
ugagaagaguguauacaaag

SEQ ID NO: 39614 - RNA, 18 nt, Homo sapiens
ugggggagaggggcgugg

SEQ ID NO: 39615 - RNA, 15 nt, Homo sapiens
cugauuuugcaccca

SEQ ID NO: 39616 - RNA, 18 nt, Homo sapiens
gaagaaagcgccgagggc

SEQ ID NO: 39617 - RNA, 23 nt, Homo sapiens
gcccccccaugacuuuccccucc

SEQ ID NO: 39618 - RNA, 16 nt, Homo sapiens
ggggugcccccccaug

SEQ ID NO: 39619 - RNA, 18 nt, Homo sapiens
guccacuucugcuuuugc

SEQ ID NO: 39620 - RNA, 17 nt, Homo sapiens
uaugguaaguagguaaa

SEQ ID NO: 39621 - RNA, 19 nt, Homo sapiens
ucgcugggugggugggagc

SEQ ID NO: 39622 - RNA, 22 nt, Homo sapiens
ugauggugguccacuucugcuu

SEQ ID NO: 39623 - RNA, 19 nt, Homo sapiens
ugcaugccgucggcagcaa

SEQ ID NO: 39624 - RNA, 18 nt, Homo sapiens
uggcaagaccaaggguuc

SEQ ID NO: 39625 - RNA, 19 nt, Homo sapiens
agugagcagguggugguaa

SEQ ID NO: 39626 - RNA, 22 nt, Homo sapiens
cgaggcuaccaaguuaaguagc

SEQ ID NO: 39627 - RNA, 19 nt, Homo sapiens
ggaauuauaagagaggggc

SEQ ID NO: 39628 - RNA, 20 nt, Homo sapiens
gggaaauaggaaaggaggaa

SEQ ID NO: 39629 - RNA, 17 nt, Homo sapiens
ucuccuccuccagcucg

SEQ ID NO: 39630 - RNA, 18 nt, Homo sapiens
ugggaaaguaagguguca

SEQ ID NO: 39631 - RNA, 17 nt, Homo sapiens
uuacaaugggaaaguaa

SEQ ID NO: 39632 - RNA, 19 nt, Homo sapiens
ccucuuagaagcauauaaa

SEQ ID NO: 39633 - RNA, 19 nt, Homo sapiens
cucgaacuccugaccuugu

SEQ ID NO: 39634 - RNA, 19 nt, Homo sapiens
gaggaugcagugagccgug

SEQ ID NO: 39635 - RNA, 21 nt, Homo sapiens
uaaaguauguuggcagguuaa

SEQ ID NO: 39636 - RNA, 21 nt, Homo sapiens
ucaugaagucauaucugggca

SEQ ID NO: 39637 - RNA, 21 nt, Homo sapiens
ucgaacuccugaccuugugau

SEQ ID NO: 39638 - RNA, 23 nt, Homo sapiens
aaggauaacacagaaaggaaaaa

SEQ ID NO: 39639 - RNA, 21 nt, Homo sapiens
cuguagugugugugugugugu

SEQ ID NO: 39640 - RNA, 17 nt, Homo sapiens
cuugugaacagguucgg

SEQ ID NO: 39641 - RNA, 19 nt, Homo sapiens
gacuguagaaaaggagagg

SEQ ID NO: 39642 - RNA, 16 nt, Homo sapiens
gagaggcaucuggggu

SEQ ID NO: 39643 - RNA, 18 nt, Homo sapiens
ggugggagaggcaucugg

SEQ ID NO: 39644 - RNA, 19 nt, Homo sapiens
uagcaaccugcaggauaua

SEQ ID NO: 39645 - RNA, 22 nt, Homo sapiens
ucuguagugugugugugugugu

SEQ ID NO: 39646 - RNA, 14 nt, Homo sapiens
ugcaauccucuucu

SEQ ID NO: 39647 - RNA, 18 nt, Homo sapiens
uggcaagcucaagugugu

SEQ ID NO: 39648 - RNA, 18 nt, Homo sapiens
ugugugugugugugauuu

SEQ ID NO: 39649 - RNA, 18 nt, Homo sapiens
ugugugugugugugugug

SEQ ID NO: 39650 - RNA, 19 nt, Homo sapiens
ugugugugugugugugugu

SEQ ID NO: 39651 - RNA, 25 nt, Homo sapiens
cccagcugcagaccugaguugcggc

SEQ ID NO: 39652 - RNA, 20 nt, Homo sapiens
ucaaggggcccccuuuugga

SEQ ID NO: 39653 - RNA, 18 nt, Homo sapiens
aaggaggaguucccgucu

SEQ ID NO: 39654 - RNA, 24 nt, Homo sapiens
acacuggcucucugcauugcaaug

SEQ ID NO: 39655 - RNA, 23 nt, Homo sapiens
accgagacgguggcccagccguc

SEQ ID NO: 39656 - RNA, 22 nt, Homo sapiens
acucgugugugugugugugugu

SEQ ID NO: 39657 - RNA, 23 nt, Homo sapiens
acucgugugugugugugugugua

SEQ ID NO: 39658 - RNA, 23 nt, Homo sapiens
agacgguaguugggccuuucuuc

SEQ ID NO: 39659 - RNA, 22 nt, Homo sapiens
agccguugcggcucaggaggac

SEQ ID NO: 39660 - RNA, 24 nt, Homo sapiens
aggcgaugaaguugguggccuggg

SEQ ID NO: 39661 - RNA, 15 nt, Homo sapiens
aggggccagggaacc

SEQ ID NO: 39662 - RNA, 21 nt, Homo sapiens
aguggcgggagggaugggagg

SEQ ID NO: 39663 - RNA, 15 nt, Homo sapiens
auccagcaggacacg

SEQ ID NO: 39664 - RNA, 18 nt, Homo sapiens
cagcggcagcaccagcuc

SEQ ID NO: 39665 - RNA, 20 nt, Homo sapiens
caggacugguucugacacag

SEQ ID NO: 39666 - RNA, 16 nt, Homo sapiens
ccaccaggaaagaaaa

SEQ ID NO: 39667 - RNA, 18 nt, Homo sapiens
gcacgcgcgcgugcacag

SEQ ID NO: 39668 - RNA, 22 nt, Homo sapiens
gcaguggccuugauuguagcag

SEQ ID NO: 39669 - RNA, 20 nt, Homo sapiens
gcguugaacgucuccuggcc

SEQ ID NO: 39670 - RNA, 17 nt, Homo sapiens
ggaagaggacaaaagag

SEQ ID NO: 39671 - RNA, 21 nt, Homo sapiens
ggccuguauguagcacagccc

SEQ ID NO: 39672 - RNA, 23 nt, Homo sapiens
gugcagcugucucugagcgugaa

SEQ ID NO: 39673 - RNA, 18 nt, Homo sapiens
uaagggaaguucuagguu

SEQ ID NO: 39674 - RNA, 18 nt, Homo sapiens
uacugacuucccucgugu

SEQ ID NO: 39675 - RNA, 19 nt, Homo sapiens
uccccagucagguuuggag

SEQ ID NO: 39676 - RNA, 15 nt, Homo sapiens
ucccugggggaaugg

SEQ ID NO: 39677 - RNA, 15 nt, Homo sapiens
ucgugugugugugug

SEQ ID NO: 39678 - RNA, 16 nt, Homo sapiens
ugggaggagacauggg

SEQ ID NO: 39679 - RNA, 18 nt, Homo sapiens
acccccuccccacgcucc

SEQ ID NO: 39680 - RNA, 23 nt, Homo sapiens
aguuguuuauggcacagugaaau

SEQ ID NO: 39681 - RNA, 18 nt, Homo sapiens
ccuuacccccuccccacg

SEQ ID NO: 39682 - RNA, 21 nt, Homo sapiens
ucucugcagcucaaaaccugc

SEQ ID NO: 39683 - RNA, 24 nt, Homo sapiens
uggcaaagcgcugcuaccgggcac

SEQ ID NO: 39684 - RNA, 21 nt, Homo sapiens
uguacggccagaaccggcuac

SEQ ID NO: 39685 - RNA, 17 nt, Homo sapiens
uucugucucccucugug

SEQ ID NO: 39686 - RNA, 16 nt, Homo sapiens
cagaauaaauccaacu

SEQ ID NO: 39687 - RNA, 16 nt, Homo sapiens
cauuucaccuggggaa

SEQ ID NO: 39688 - RNA, 21 nt, Homo sapiens
gcuuucuacuggagauacaga

SEQ ID NO: 39689 - RNA, 18 nt, Homo sapiens
ucauugauuucucuuuca

SEQ ID NO: 39690 - RNA, 18 nt, Homo sapiens
gacgggguggaggguggg

SEQ ID NO: 39691 - RNA, 18 nt, Homo sapiens
gcugggcagugcccaccg

SEQ ID NO: 39692 - RNA, 19 nt, Homo sapiens
uggcaugcggugcugggca

SEQ ID NO: 39693 - RNA, 22 nt, Homo sapiens
agugaaaggggaggggaggaag

SEQ ID NO: 39694 - RNA, 20 nt, Homo sapiens
cgagcgacgcgcagccggcg

SEQ ID NO: 39695 - RNA, 16 nt, Homo sapiens
cuacuuguauauacca

SEQ ID NO: 39696 - RNA, 25 nt, Homo sapiens
cuggauuucaguaaggcaauguggc

SEQ ID NO: 39697 - RNA, 17 nt, Homo sapiens
gcagccggcggugggau

SEQ ID NO: 39698 - RNA, 25 nt, Homo sapiens
gggaggaaggucagggaggagcggg

SEQ ID NO: 39699 - RNA, 23 nt, Homo sapiens
ggggaggaaggucagggaggagc

SEQ ID NO: 39700 - RNA, 25 nt, Homo sapiens
ggggaggaaggucagggaggagcgg

SEQ ID NO: 39701 - RNA, 19 nt, Homo sapiens
uuaagaaauauauaguguc

SEQ ID NO: 39702 - RNA, 18 nt, Homo sapiens
aaaaagaaaaaaaacagg

SEQ ID NO: 39703 - RNA, 20 nt, Homo sapiens
aacaagggguuggggacuca

SEQ ID NO: 39704 - RNA, 16 nt, Homo sapiens
agaaaggcucaaaguu

SEQ ID NO: 39705 - RNA, 18 nt, Homo sapiens
cacaugccaauuauuugg

SEQ ID NO: 39706 - RNA, 22 nt, Homo sapiens
cauacaaauaauuugcacuaua

SEQ ID NO: 39707 - RNA, 20 nt, Homo sapiens
cccuaugacagccauccaug

SEQ ID NO: 39708 - RNA, 18 nt, Homo sapiens
cggcggcggcgggcggac

SEQ ID NO: 39709 - RNA, 18 nt, Homo sapiens
cgggcggcggcggcggcg

SEQ ID NO: 39710 - RNA, 17 nt, Homo sapiens
cggggcgggcggcggcg

SEQ ID NO: 39711 - RNA, 19 nt, Homo sapiens
cuuagcuucguuacuucug

SEQ ID NO: 39712 - RNA, 23 nt, Homo sapiens
gcugguuucagaagggccagggc

SEQ ID NO: 39713 - RNA, 22 nt, Homo sapiens
gcugugauugucuguucugaug

SEQ ID NO: 39714 - RNA, 17 nt, Homo sapiens
ggcgauggggaagggga

SEQ ID NO: 39715 - RNA, 23 nt, Homo sapiens
ggcggcggcggcggcggcggcgg

SEQ ID NO: 39716 - RNA, 23 nt, Homo sapiens
ggcggcggcgggcggacgacggc

SEQ ID NO: 39717 - RNA, 20 nt, Homo sapiens
ggggaguggugaaaaagggg

SEQ ID NO: 39718 - RNA, 23 nt, Homo sapiens
uaaugggucaucuuuuuagguag

SEQ ID NO: 39719 - RNA, 17 nt, Homo sapiens
uacaauaaaaagccagg

SEQ ID NO: 39720 - RNA, 22 nt, Homo sapiens
uauuucuuuuggugccaguauu

SEQ ID NO: 39721 - RNA, 18 nt, Homo sapiens
ucgacugggcggcacgcg

SEQ ID NO: 39722 - RNA, 20 nt, Homo sapiens
ugggagagccgucauggcuu

SEQ ID NO: 39723 - RNA, 19 nt, Homo sapiens
uuaauuguccuaucugagc

SEQ ID NO: 39724 - RNA, 19 nt, Homo sapiens
uuugcguaaaaugcaauag

SEQ ID NO: 39725 - RNA, 27 nt, Homo sapiens
uugaugagguaagaguugaaaugacuu

SEQ ID NO: 39726 - RNA, 21 nt, Homo sapiens
aucacccuuccaccccauucc

SEQ ID NO: 39727 - RNA, 20 nt, Homo sapiens
caggagacauucugaaagac

SEQ ID NO: 39728 - RNA, 20 nt, Homo sapiens
gagguaggguuggggccggg

SEQ ID NO: 39729 - RNA, 21 nt, Homo sapiens
gccggaguucgcggcugccgc

SEQ ID NO: 39730 - RNA, 20 nt, Homo sapiens
gcuagcuccggccgggccac

SEQ ID NO: 39731 - RNA, 23 nt, Homo sapiens
ggggaaagagccuccaaacugac

SEQ ID NO: 39732 - RNA, 17 nt, Homo sapiens
ggucaaugguaaaguca

SEQ ID NO: 39733 - RNA, 15 nt, Homo sapiens
ucuuugaauguccag

SEQ ID NO: 39734 - RNA, 18 nt, Homo sapiens
ugcccuuguggaugcgcc

SEQ ID NO: 39735 - RNA, 16 nt, Homo sapiens
ugggcuauuucaaccc

SEQ ID NO: 39736 - RNA, 16 nt, Homo sapiens
uguuuucauuccaaca

SEQ ID NO: 39737 - RNA, 21 nt, Homo sapiens
cacaccgccccaggcugcccg

SEQ ID NO: 39738 - RNA, 19 nt, Homo sapiens
ccagccgcucccaggcacc

SEQ ID NO: 39739 - RNA, 17 nt, Homo sapiens
cgucccaauccagagac

SEQ ID NO: 39740 - RNA, 20 nt, Homo sapiens
gagaggccaugcugugacau

SEQ ID NO: 39741 - RNA, 23 nt, Homo sapiens
aacuacuuccuuuugcgagacgu

SEQ ID NO: 39742 - RNA, 19 nt, Homo sapiens
aauguccaauuuauuuuua

SEQ ID NO: 39743 - RNA, 23 nt, Homo sapiens
agaaaagguaauaaaaauauuuu

SEQ ID NO: 39744 - RNA, 16 nt, Homo sapiens
cacauuuugcuuagag

SEQ ID NO: 39745 - RNA, 18 nt, Homo sapiens
cauucccuccccccuuuu

SEQ ID NO: 39746 - RNA, 16 nt, Homo sapiens
cccccagcaccaccac

SEQ ID NO: 39747 - RNA, 26 nt, Homo sapiens
ccgccgccgcaccuccuccucugccc

SEQ ID NO: 39748 - RNA, 19 nt, Homo sapiens
cucucccauucccuccccc

SEQ ID NO: 39749 - RNA, 18 nt, Homo sapiens
gcggggcgccggggcccg

SEQ ID NO: 39750 - RNA, 17 nt, Homo sapiens
ggagccgggggaggggg

SEQ ID NO: 39751 - RNA, 17 nt, Homo sapiens
gggggagccgggggagg

SEQ ID NO: 39752 - RNA, 24 nt, Homo sapiens
gggggagccgggggaggggguccg

SEQ ID NO: 39753 - RNA, 18 nt, Homo sapiens
ggggggagccgggggagg

SEQ ID NO: 39754 - RNA, 21 nt, Homo sapiens
uaaagugcgggucaacagaau

SEQ ID NO: 39755 - RNA, 20 nt, Homo sapiens
ucuacagcgaauagcagcca

SEQ ID NO: 39756 - RNA, 22 nt, Homo sapiens
ucucucgguuggcaacgguucc

SEQ ID NO: 39757 - RNA, 18 nt, Homo sapiens
ucucuuucccucucuucc

SEQ ID NO: 39758 - RNA, 21 nt, Homo sapiens
ucuggcaucgcccggagagcu

SEQ ID NO: 39759 - RNA, 16 nt, Homo sapiens
ugccacgcuuagcaau

SEQ ID NO: 39760 - RNA, 22 nt, Homo sapiens
ugccuguuucuuaaacagagca

SEQ ID NO: 39761 - RNA, 18 nt, Homo sapiens
ugcuugggaaaugaugga

SEQ ID NO: 39762 - RNA, 17 nt, Homo sapiens
uggcggcgcugagucug

SEQ ID NO: 39763 - RNA, 18 nt, Homo sapiens
ugggaaguagcgcugggc

SEQ ID NO: 39764 - RNA, 19 nt, Homo sapiens
uguuuugcuuuucauucaa

SEQ ID NO: 39765 - RNA, 15 nt, Homo sapiens
uuucuuacauuuccu

SEQ ID NO: 39766 - RNA, 18 nt, Homo sapiens
agaaaggacauuuggagg

SEQ ID NO: 39767 - RNA, 19 nt, Homo sapiens
augaaggaaagcaccaggg

SEQ ID NO: 39768 - RNA, 19 nt, Homo sapiens
augcguccaauuguauaaa

SEQ ID NO: 39769 - RNA, 21 nt, Homo sapiens
ccagccuucauggguuggguc

SEQ ID NO: 39770 - RNA, 21 nt, Homo sapiens
ccccugcucaccauuggagaa

SEQ ID NO: 39771 - RNA, 15 nt, Homo sapiens
cgggaccccccugcc

SEQ ID NO: 39772 - RNA, 17 nt, Homo sapiens
cgugggagaugaaggaa

SEQ ID NO: 39773 - RNA, 17 nt, Homo sapiens
gaagggggcgccaaggc

SEQ ID NO: 39774 - RNA, 18 nt, Homo sapiens
gcugaaggggcgcggcgg

SEQ ID NO: 39775 - RNA, 20 nt, Homo sapiens
ucaaaacgcugagaacagcc

SEQ ID NO: 39776 - RNA, 16 nt, Homo sapiens
ucaaacguugugagcc

SEQ ID NO: 39777 - RNA, 17 nt, Homo sapiens
ugcacuuuuaaaagcag

SEQ ID NO: 39778 - RNA, 17 nt, Homo sapiens
uggcaaacuuuccuuuu

SEQ ID NO: 39779 - RNA, 19 nt, Homo sapiens
ugugcacuuuuaaaagcag

SEQ ID NO: 39780 - RNA, 19 nt, Homo sapiens
ugaacaggccuuguuuuuc

SEQ ID NO: 39781 - RNA, 18 nt, Homo sapiens
auggcagcuggugauuuu

SEQ ID NO: 39782 - RNA, 20 nt, Homo sapiens
caacucaucacuccguggcc

SEQ ID NO: 39783 - RNA, 14 nt, Homo sapiens
cagggcagccugcc

SEQ ID NO: 39784 - RNA, 21 nt, Homo sapiens
caguggcuucagugaaugcca

SEQ ID NO: 39785 - RNA, 18 nt, Homo sapiens
cauccagcagcuagagug

SEQ ID NO: 39786 - RNA, 18 nt, Homo sapiens
ccagagauguccgauugc

SEQ ID NO: 39787 - RNA, 22 nt, Homo sapiens
gcaaggggcagggaggaaccag

SEQ ID NO: 39788 - RNA, 20 nt, Homo sapiens
ugucccaggaucacauccag

SEQ ID NO: 39789 - RNA, 21 nt, Homo sapiens
ucaaggauucagccuccacag

SEQ ID NO: 39790 - RNA, 15 nt, Homo sapiens
ugcccuuaaguggac

SEQ ID NO: 39791 - RNA, 22 nt, Homo sapiens
aguguuugcucaaaaaucuuuu

SEQ ID NO: 39792 - RNA, 17 nt, Homo sapiens
acugagggggcagggga

SEQ ID NO: 39793 - RNA, 20 nt, Homo sapiens
ccggcuccgcuccgcgcggc

SEQ ID NO: 39794 - RNA, 19 nt, Homo sapiens
gccuggccgcagggucccc

SEQ ID NO: 39795 - RNA, 22 nt, Homo sapiens
gcuggcucggguuagcucgccg

SEQ ID NO: 39796 - RNA, 15 nt, Homo sapiens
uggaaaacugagggg

SEQ ID NO: 39797 - RNA, 17 nt, Homo sapiens
uggaaaacugagggggc

SEQ ID NO: 39798 - RNA, 16 nt, Homo sapiens
ggagguugcagagagc

SEQ ID NO: 39799 - RNA, 20 nt, Homo sapiens
uggagggcuugugaaagaaa

SEQ ID NO: 39800 - RNA, 22 nt, Homo sapiens
aaugcaugaauuuuaaaugaca

SEQ ID NO: 39801 - RNA, 18 nt, Homo sapiens
aggaaguugccuuguggu

SEQ ID NO: 39802 - RNA, 20 nt, Homo sapiens
caaaaagcauggagaaaugg

SEQ ID NO: 39803 - RNA, 19 nt, Homo sapiens
caccagaugccuaaagaag

SEQ ID NO: 39804 - RNA, 22 nt, Homo sapiens
ccucacuuccccagcuuauuau

SEQ ID NO: 39805 - RNA, 22 nt, Homo sapiens
uagcuuaacuauggguugagga

SEQ ID NO: 39806 - RNA, 16 nt, Homo sapiens
uccacauucucucuuc

SEQ ID NO: 39807 - RNA, 16 nt, Homo sapiens
ucuguuucugucuccu

SEQ ID NO: 39808 - RNA, 20 nt, Homo sapiens
ugaaagaaagcaugugcagg

SEQ ID NO: 39809 - RNA, 22 nt, Homo sapiens
ugacagaucagggagcagggug

SEQ ID NO: 39810 - RNA, 19 nt, Homo sapiens
uggaagaaggguaaagaag

SEQ ID NO: 39811 - RNA, 19 nt, Homo sapiens
uggcauuuuuacaucuuug

SEQ ID NO: 39812 - RNA, 23 nt, Homo sapiens
uguggaaaaaaaacuuaaaaagu

SEQ ID NO: 39813 - RNA, 19 nt, Homo sapiens
uugaagggcaaguucaccu

SEQ ID NO: 39814 - RNA, 16 nt, Homo sapiens
aauggccuuguuguau

SEQ ID NO: 39815 - RNA, 18 nt, Homo sapiens
cgguguccucgaggccga

SEQ ID NO: 39816 - RNA, 19 nt, Homo sapiens
ggccacggcggcguggcgc

SEQ ID NO: 39817 - RNA, 19 nt, Homo sapiens
gaauuaaugauugaaugaa

SEQ ID NO: 39818 - RNA, 18 nt, Homo sapiens
gcccuuugguuguacaug

SEQ ID NO: 39819 - RNA, 24 nt, Homo sapiens
aggcuguuuacuaacgugaauagc

SEQ ID NO: 39820 - RNA, 19 nt, Homo sapiens
caauagcugugagcuuggc

SEQ ID NO: 39821 - RNA, 23 nt, Homo sapiens
ccucagguucucaauggagggcc

SEQ ID NO: 39822 - RNA, 20 nt, Homo sapiens
gcaguggugucccuggccac

SEQ ID NO: 39823 - RNA, 21 nt, Homo sapiens
gggcuuuuggacaccuugggg

SEQ ID NO: 39824 - RNA, 15 nt, Homo sapiens
uggcccaucaaagcc

SEQ ID NO: 39825 - RNA, 18 nt, Homo sapiens
uguggucccugagaaaag

SEQ ID NO: 39826 - RNA, 15 nt, Homo sapiens
uucccauccaccgug

SEQ ID NO: 39827 - RNA, 18 nt, Homo sapiens
uuccucagguucucaaug

SEQ ID NO: 39828 - RNA, 18 nt, Homo sapiens
caccacuuaucuuuacag

SEQ ID NO: 39829 - RNA, 20 nt, Homo sapiens
cccuggccacggaauggcug

SEQ ID NO: 39830 - RNA, 21 nt, Homo sapiens
agcacgggguuuuuccuuuuc

SEQ ID NO: 39831 - RNA, 19 nt, Homo sapiens
gcucccgccgccgcauccc

SEQ ID NO: 39832 - RNA, 17 nt, Homo sapiens
ggccgcgccgcugcugc

SEQ ID NO: 39833 - RNA, 17 nt, Homo sapiens
ucgcgaggagcuagggg

SEQ ID NO: 39834 - RNA, 18 nt, Homo sapiens
aaaacacuguggauguua

SEQ ID NO: 39835 - RNA, 19 nt, Homo sapiens
aaaacgucacuuaucacag

SEQ ID NO: 39836 - RNA, 17 nt, Homo sapiens
agacuauuucuauacaa

SEQ ID NO: 39837 - RNA, 21 nt, Homo sapiens
agcgcggagcggguggcugcu

SEQ ID NO: 39838 - RNA, 19 nt, Homo sapiens
agggaggccacuucgccgg

SEQ ID NO: 39839 - RNA, 21 nt, Homo sapiens
cgcggagcggguggcugcucc

SEQ ID NO: 39840 - RNA, 20 nt, Homo sapiens
cgugugugugugugugugua

SEQ ID NO: 39841 - RNA, 28 nt, Homo sapiens
cuguggauucguguguguguguguguac

SEQ ID NO: 39842 - RNA, 20 nt, Homo sapiens
gcgcaggggagcgggcggcg

SEQ ID NO: 39843 - RNA, 17 nt, Homo sapiens
gcucugaugucauaaaa

SEQ ID NO: 39844 - RNA, 22 nt, Homo sapiens
ggagcgggcggcgcggaguggg

SEQ ID NO: 39845 - RNA, 21 nt, Homo sapiens
gggcuggggugcggcgggggg

SEQ ID NO: 39846 - RNA, 20 nt, Homo sapiens
ggggagcgggcggcgcggag

SEQ ID NO: 39847 - RNA, 23 nt, Homo sapiens
ggggagcgggcggcgcggagugg

SEQ ID NO: 39848 - RNA, 21 nt, Homo sapiens
uaagauacauauguauauaug

SEQ ID NO: 39849 - RNA, 16 nt, Homo sapiens
uagccgaggcgaaugc

SEQ ID NO: 39850 - RNA, 14 nt, Homo sapiens
ucccagauuuccag

SEQ ID NO: 39851 - RNA, 20 nt, Homo sapiens
ugaugcuguaguacuccuuu

SEQ ID NO: 39852 - RNA, 18 nt, Homo sapiens
ugugugugugugugugug

SEQ ID NO: 39853 - RNA, 19 nt, Homo sapiens
ugugugugugugugugugu

SEQ ID NO: 39854 - RNA, 19 nt, Homo sapiens
uuagcaacacuuauaacau

SEQ ID NO: 39855 - RNA, 20 nt, Homo sapiens
uuauguuuuguguugguuuu

SEQ ID NO: 39856 - RNA, 15 nt, Homo sapiens
ccccuauccgguucu

SEQ ID NO: 39857 - RNA, 23 nt, Homo sapiens
gagggagggggaagggcugggug

SEQ ID NO: 39858 - RNA, 19 nt, Homo sapiens
gcugggagugcacuacaga

SEQ ID NO: 39859 - RNA, 19 nt, Homo sapiens
ggaggggaguucccaucca

SEQ ID NO: 39860 - RNA, 19 nt, Homo sapiens
uugcugucuaaaacaugaa

SEQ ID NO: 39861 - RNA, 18 nt, Homo sapiens
aagguuuuauagcaaguc

SEQ ID NO: 39862 - RNA, 15 nt, Homo sapiens
agaagagaagccacu

SEQ ID NO: 39863 - RNA, 18 nt, Homo sapiens
cauuucuaaacauauauu

SEQ ID NO: 39864 - RNA, 20 nt, Homo sapiens
ccaggcuggugagacacagc

SEQ ID NO: 39865 - RNA, 20 nt, Homo sapiens
gcuguugaucuucccuucug

SEQ ID NO: 39866 - RNA, 21 nt, Homo sapiens
ugacaggaggugccuccugag

SEQ ID NO: 39867 - RNA, 21 nt, Homo sapiens
ugauagguaaaagaagauauu

SEQ ID NO: 39868 - RNA, 15 nt, Homo sapiens
ugcagacacggucau

SEQ ID NO: 39869 - RNA, 18 nt, Homo sapiens
cagcccaacagccgcucc

SEQ ID NO: 39870 - RNA, 17 nt, Homo sapiens
cccgccgccgccucucg

SEQ ID NO: 39871 - RNA, 19 nt, Homo sapiens
ccgccgccucucgccgggu

SEQ ID NO: 39872 - RNA, 22 nt, Homo sapiens
aggaagaggagaggguaggaga

SEQ ID NO: 39873 - RNA, 23 nt, Homo sapiens
cccaagcauacuuuccugcuuug

SEQ ID NO: 39874 - RNA, 14 nt, Homo sapiens
cucccgcccucugu

SEQ ID NO: 39875 - RNA, 16 nt, Homo sapiens
cugcuccugaauggac

SEQ ID NO: 39876 - RNA, 18 nt, Homo sapiens
gccccagucggcuggagc

SEQ ID NO: 39877 - RNA, 16 nt, Homo sapiens
ggagaggguaggagag

SEQ ID NO: 39878 - RNA, 22 nt, Homo sapiens
uaucaugauuuucccagcaccu

SEQ ID NO: 39879 - RNA, 20 nt, Homo sapiens
uccugcuccugaauggacuc

SEQ ID NO: 39880 - RNA, 20 nt, Homo sapiens
ucggcuggagcugaacuugc

SEQ ID NO: 39881 - RNA, 19 nt, Homo sapiens
aagaaugcugaacaggaaa

SEQ ID NO: 39882 - RNA, 21 nt, Homo sapiens
acggcgggcguccugcggcgg

SEQ ID NO: 39883 - RNA, 21 nt, Homo sapiens
agugcuauugggaaaauacug

SEQ ID NO: 39884 - RNA, 24 nt, Homo sapiens
ggcuggcgguugggcagcggcgcc

SEQ ID NO: 39885 - RNA, 20 nt, Homo sapiens
acaggugugagccaccacgc

SEQ ID NO: 39886 - RNA, 17 nt, Homo sapiens
agccaccacgccuggcc

SEQ ID NO: 39887 - RNA, 17 nt, Homo sapiens
aggaagauuaggagagg

SEQ ID NO: 39888 - RNA, 21 nt, Homo sapiens
uuucaggaucagauacuguac

SEQ ID NO: 39889 - RNA, 20 nt, Homo sapiens
uuuuucacugccgacuggcc

SEQ ID NO: 39890 - RNA, 18 nt, Homo sapiens
uccuccaguuaccggggc

SEQ ID NO: 39891 - RNA, 25 nt, Homo sapiens
uuaaugggguuguuuugacacuugg

SEQ ID NO: 39892 - RNA, 22 nt, Homo sapiens
aggaaccuaaaugaggaugcag

SEQ ID NO: 39893 - RNA, 17 nt, Homo sapiens
cauacaccaaguuuaaa

SEQ ID NO: 39894 - RNA, 19 nt, Homo sapiens
ccacugaguggggagacag

SEQ ID NO: 39895 - RNA, 18 nt, Homo sapiens
ccagcucccccggccccu

SEQ ID NO: 39896 - RNA, 18 nt, Homo sapiens
cugccgccucuucucggu

SEQ ID NO: 39897 - RNA, 27 nt, Homo sapiens
gaguggggugaaauguuagcauagcug

SEQ ID NO: 39898 - RNA, 17 nt, Homo sapiens
gcgugguggcgggcgcc

SEQ ID NO: 39899 - RNA, 17 nt, Homo sapiens
ugcaccccuucucuuag

SEQ ID NO: 39900 - RNA, 17 nt, Homo sapiens
ugccgugucccuccucc

SEQ ID NO: 39901 - RNA, 18 nt, Homo sapiens
uugaagccgggaggcaca

SEQ ID NO: 39902 - RNA, 20 nt, Homo sapiens
aaacugaaaacuagaacaaa

SEQ ID NO: 39903 - RNA, 27 nt, Homo sapiens
aagcugaagacacaugggagugggagg

SEQ ID NO: 39904 - RNA, 22 nt, Homo sapiens
auauauauauauauuuauauau

SEQ ID NO: 39905 - RNA, 18 nt, Homo sapiens
caggggaggacuuggugu

SEQ ID NO: 39906 - RNA, 22 nt, Homo sapiens
uauauauauauauauuuauaua

SEQ ID NO: 39907 - RNA, 28 nt, Homo sapiens
uauauauauuuauuuuauauauauauau

SEQ ID NO: 39908 - RNA, 29 nt, Homo sapiens
uauauauauuuauuuuauauauauauaua

SEQ ID NO: 39909 - RNA, 30 nt, Homo sapiens
uauauauauuuauuuuauauauauauauau

SEQ ID NO: 39910 - RNA, 21 nt, Homo sapiens
ucggacuuuaccacugcuacg

SEQ ID NO: 39911 - RNA, 15 nt, Homo sapiens
uuuugcauacucccc

SEQ ID NO: 39912 - RNA, 23 nt, Homo sapiens
uuuuuuguucuuuuuguuuuuuu

SEQ ID NO: 39913 - RNA, 26 nt, Homo sapiens
acagcucagccaccuguucuggcugc

SEQ ID NO: 39914 - RNA, 17 nt, Homo sapiens
aggggcaggccaagaac

SEQ ID NO: 39915 - RNA, 17 nt, Homo sapiens
ccagccagaagacucag

SEQ ID NO: 39916 - RNA, 19 nt, Homo sapiens
ccagccgcuccaggcgccc

SEQ ID NO: 39917 - RNA, 18 nt, Homo sapiens
ccugccguauuaaaacaa

SEQ ID NO: 39918 - RNA, 23 nt, Homo sapiens
cucgcagcucgugaaucuccugc

SEQ ID NO: 39919 - RNA, 22 nt, Homo sapiens
gaggaaacaggcggagcgaucc

SEQ ID NO: 39920 - RNA, 21 nt, Homo sapiens
gcacugguugggggcucuggg

SEQ ID NO: 39921 - RNA, 17 nt, Homo sapiens
gcggggggaagggugag

SEQ ID NO: 39922 - RNA, 21 nt, Homo sapiens
gggaagggcgggcugcuuggg

SEQ ID NO: 39923 - RNA, 17 nt, Homo sapiens
ggggaagggcgggcugc

SEQ ID NO: 39924 - RNA, 14 nt, Homo sapiens
gucucuggaccgag

SEQ ID NO: 39925 - RNA, 18 nt, Homo sapiens
uaacgcgguacauggucc

SEQ ID NO: 39926 - RNA, 23 nt, Homo sapiens
uacaguuauguuuugccuccugu

SEQ ID NO: 39927 - RNA, 24 nt, Homo sapiens
ucuggcugcagcucuucaggcggc

SEQ ID NO: 39928 - RNA, 21 nt, Homo sapiens
ugaaaauaaagagagagagag

SEQ ID NO: 39929 - RNA, 17 nt, Homo sapiens
ugaggaaagagaacgca

SEQ ID NO: 39930 - RNA, 19 nt, Homo sapiens
uggaaggagaccccugugg

SEQ ID NO: 39931 - RNA, 18 nt, Homo sapiens
uguuaaggaauugaagca

SEQ ID NO: 39932 - RNA, 19 nt, Homo sapiens
ucucucaccaaaugucgag

SEQ ID NO: 39933 - RNA, 23 nt, Homo sapiens
agcagaaguuucucccucuuccu

SEQ ID NO: 39934 - RNA, 23 nt, Homo sapiens
aguucuuuuuuauuucuuuaaua

SEQ ID NO: 39935 - RNA, 18 nt, Homo sapiens
gaccgcuguguaggaaaa

SEQ ID NO: 39936 - RNA, 21 nt, Homo sapiens
gaggggaggggacccaugggg

SEQ ID NO: 39937 - RNA, 19 nt, Homo sapiens
ugggacagaaaggggugac

SEQ ID NO: 39938 - RNA, 21 nt, Homo sapiens
agguggaagaguucuucgggu

SEQ ID NO: 39939 - RNA, 15 nt, Homo sapiens
cagccgccggcuucc

SEQ ID NO: 39940 - RNA, 18 nt, Homo sapiens
ccaggccugcggaagugg

SEQ ID NO: 39941 - RNA, 17 nt, Homo sapiens
ccugcggaaguggugga

SEQ ID NO: 39942 - RNA, 22 nt, Homo sapiens
gaggaagaguugccagaauucg

SEQ ID NO: 39943 - RNA, 20 nt, Homo sapiens
uaaagaaagaaaaaaaaaag

SEQ ID NO: 39944 - RNA, 19 nt, Homo sapiens
uccggagaaggaaguuugc

SEQ ID NO: 39945 - RNA, 24 nt, Homo sapiens
aaacugacucaguauucuuguuuu

SEQ ID NO: 39946 - RNA, 21 nt, Homo sapiens
agagcuaaaaaagagcucuuu

SEQ ID NO: 39947 - RNA, 20 nt, Homo sapiens
agcucuugugguggaggaca

SEQ ID NO: 39948 - RNA, 24 nt, Homo sapiens
aggagcggggaggggaagaacagg

SEQ ID NO: 39949 - RNA, 25 nt, Homo sapiens
aggggugaggagggggcuuaacugc

SEQ ID NO: 39950 - RNA, 19 nt, Homo sapiens
aguaggaugcaguggguau

SEQ ID NO: 39951 - RNA, 22 nt, Homo sapiens
aguggacagucuccagucuucc

SEQ ID NO: 39952 - RNA, 20 nt, Homo sapiens
auacuaggaaaacccagcuc

SEQ ID NO: 39953 - RNA, 19 nt, Homo sapiens
cacuggggugaggagaugu

SEQ ID NO: 39954 - RNA, 17 nt, Homo sapiens
ccagaggaagauuuggg

SEQ ID NO: 39955 - RNA, 16 nt, Homo sapiens
ccccacuaccuagccc

SEQ ID NO: 39956 - RNA, 18 nt, Homo sapiens
cccugucuuuguacuccc

SEQ ID NO: 39957 - RNA, 18 nt, Homo sapiens
ccucuuuccagccgcccc

SEQ ID NO: 39958 - RNA, 17 nt, Homo sapiens
cggcgggcggcggcgcg

SEQ ID NO: 39959 - RNA, 20 nt, Homo sapiens
cucgcagcucccgggcgggc

SEQ ID NO: 39960 - RNA, 18 nt, Homo sapiens
gagagggagcuugggggc

SEQ ID NO: 39961 - RNA, 18 nt, Homo sapiens
gaggggcgggcauggcgg

SEQ ID NO: 39962 - RNA, 20 nt, Homo sapiens
gcaaauuuagaaauugaaaa

SEQ ID NO: 39963 - RNA, 23 nt, Homo sapiens
gggcagcgggcgcgggcucccgg

SEQ ID NO: 39964 - RNA, 20 nt, Homo sapiens
gggcggcggcgcgggcaggg

SEQ ID NO: 39965 - RNA, 20 nt, Homo sapiens
ggguccgggcuguggagagc

SEQ ID NO: 39966 - RNA, 19 nt, Homo sapiens
gguuuauggcuugugggca

SEQ ID NO: 39967 - RNA, 25 nt, Homo sapiens
guggcauuuucacuucaugguagca

SEQ ID NO: 39968 - RNA, 19 nt, Homo sapiens
uaaaacuaggacuggugag

SEQ ID NO: 39969 - RNA, 19 nt, Homo sapiens
uaccacagggacacacgcc

SEQ ID NO: 39970 - RNA, 16 nt, Homo sapiens
uagccuaauaggaaga

SEQ ID NO: 39971 - RNA, 18 nt, Homo sapiens
ucacuugcucugugggua

SEQ ID NO: 39972 - RNA, 22 nt, Homo sapiens
ucuuuguacucccucuccuucu

SEQ ID NO: 39973 - RNA, 23 nt, Homo sapiens
ugccagccuuuuccuucuccauc

SEQ ID NO: 39974 - RNA, 18 nt, Homo sapiens
uggggugaggagaugucu

SEQ ID NO: 39975 - RNA, 18 nt, Homo sapiens
uuuggugaccuuggguga

SEQ ID NO: 39976 - RNA, 25 nt, Homo sapiens
ugugucugcauuugugugugugugu

SEQ ID NO: 39977 - RNA, 18 nt, Homo sapiens
agggguccugccgaggcu

SEQ ID NO: 39978 - RNA, 20 nt, Homo sapiens
ccacagcuuguaugguuucu

SEQ ID NO: 39979 - RNA, 24 nt, Homo sapiens
cugcauuugugugugugugugugu

SEQ ID NO: 39980 - RNA, 18 nt, Homo sapiens
gaagaaggagaaacagga

SEQ ID NO: 39981 - RNA, 17 nt, Homo sapiens
ggcaaaggagaagaaaa

SEQ ID NO: 39982 - RNA, 21 nt, Homo sapiens
uaaguaaagauaugagugacu

SEQ ID NO: 39983 - RNA, 21 nt, Homo sapiens
ugugucugcgugugugugugu

SEQ ID NO: 39984 - RNA, 20 nt, Homo sapiens
uguuugguucugaaaggguc

SEQ ID NO: 39985 - RNA, 21 nt, Homo sapiens
aaugugauuuucuuaauagcu

SEQ ID NO: 39986 - RNA, 17 nt, Homo sapiens
aguaagcauaugugaua

SEQ ID NO: 39987 - RNA, 18 nt, Homo sapiens
caccgggaccggcggcgg

SEQ ID NO: 39988 - RNA, 18 nt, Homo sapiens
ccugcagcccaauccacu

SEQ ID NO: 39989 - RNA, 17 nt, Homo sapiens
gagaaggcggaggccgg

SEQ ID NO: 39990 - RNA, 20 nt, Homo sapiens
gcgcggaggcgcagagccgc

SEQ ID NO: 39991 - RNA, 20 nt, Homo sapiens
gcggcggggaggacgggagg

SEQ ID NO: 39992 - RNA, 19 nt, Homo sapiens
gggaggcgggcgcggaggc

SEQ ID NO: 39993 - RNA, 19 nt, Homo sapiens
gggcucggggggcgccggg

SEQ ID NO: 39994 - RNA, 22 nt, Homo sapiens
gggggcgccgggguccaccugc

SEQ ID NO: 39995 - RNA, 18 nt, Homo sapiens
gugggcacaggagaaagc

SEQ ID NO: 39996 - RNA, 20 nt, Homo sapiens
ucgcgggaggggagaaggcg

SEQ ID NO: 39997 - RNA, 23 nt, Homo sapiens
ucggccggcgcgcggggcugcgg

SEQ ID NO: 39998 - RNA, 17 nt, Homo sapiens
uugaagagagaagagaa

SEQ ID NO: 39999 - RNA, 18 nt, Homo sapiens
uugaagagagaagagaac

SEQ ID NO: 40000 - RNA, 16 nt, Homo sapiens
cacagugagucugcag

SEQ ID NO: 40001 - RNA, 21 nt, Homo sapiens
cagcacccugggauuacaggc

SEQ ID NO: 40002 - RNA, 15 nt, Homo sapiens
cccaguaaaacuucc

SEQ ID NO: 40003 - RNA, 20 nt, Homo sapiens
ccuaggcucaggagaugccc

SEQ ID NO: 40004 - RNA, 17 nt, Homo sapiens
cucuccugaaacaugaa

SEQ ID NO: 40005 - RNA, 19 nt, Homo sapiens
cucuccugaaacaugaaga

SEQ ID NO: 40006 - RNA, 21 nt, Homo sapiens
gcccaguaaaacuuccuggug

SEQ ID NO: 40007 - RNA, 19 nt, Homo sapiens
uuaguucucucucuccuac

SEQ ID NO: 40008 - RNA, 20 nt, Homo sapiens
ggaaaaguugaacgggucca

SEQ ID NO: 40009 - RNA, 18 nt, Homo sapiens
auuucuccccaaaccaag

SEQ ID NO: 40010 - RNA, 17 nt, Homo sapiens
cacgcacgcacaccccc

SEQ ID NO: 40011 - RNA, 16 nt, Homo sapiens
cgccccuacaaggccg

SEQ ID NO: 40012 - RNA, 21 nt, Homo sapiens
gaaacaccuuggcccaaauac

SEQ ID NO: 40013 - RNA, 19 nt, Homo sapiens
ggaggaaaucucugcaaca

SEQ ID NO: 40014 - RNA, 19 nt, Homo sapiens
ggucacaggagaagccaaa

SEQ ID NO: 40015 - RNA, 20 nt, Homo sapiens
uauacauccaccuguuccuc

SEQ ID NO: 40016 - RNA, 18 nt, Homo sapiens
ucagagaaaucaggagau

SEQ ID NO: 40017 - RNA, 21 nt, Homo sapiens
uccaccauggaggaaaucucu

SEQ ID NO: 40018 - RNA, 18 nt, Homo sapiens
uccagcugcugcgcccgc

SEQ ID NO: 40019 - RNA, 18 nt, Homo sapiens
uugauuuucagcauuucu

SEQ ID NO: 40020 - RNA, 15 nt, Homo sapiens
agcugcagccacagc

SEQ ID NO: 40021 - RNA, 15 nt, Homo sapiens
ggcaaaccacaggaa

SEQ ID NO: 40022 - RNA, 17 nt, Homo sapiens
ggcagaggcgcagcauc

SEQ ID NO: 40023 - RNA, 19 nt, Homo sapiens
ugacuugucaacagccuga

SEQ ID NO: 40024 - RNA, 18 nt, Homo sapiens
ugauguauauuugaccac

SEQ ID NO: 40025 - RNA, 20 nt, Homo sapiens
acgaccauccuccaggaggg

SEQ ID NO: 40026 - RNA, 22 nt, Homo sapiens
acgcggcacugcucguuggcgc

SEQ ID NO: 40027 - RNA, 18 nt, Homo sapiens
cacgcggcacugcucguu

SEQ ID NO: 40028 - RNA, 25 nt, Homo sapiens
cagcaucuuccuggaggggucccca

SEQ ID NO: 40029 - RNA, 26 nt, Homo sapiens
ccccuggcacacaggucucguucucc

SEQ ID NO: 40030 - RNA, 18 nt, Homo sapiens
ccugcagcccaguccugc

SEQ ID NO: 40031 - RNA, 19 nt, Homo sapiens
cgcggcacugcucguuggc

SEQ ID NO: 40032 - RNA, 15 nt, Homo sapiens
cgugggcugcacguc

SEQ ID NO: 40033 - RNA, 19 nt, Homo sapiens
cugcagcugcuuuggucca

SEQ ID NO: 40034 - RNA, 16 nt, Homo sapiens
gagcugggcucugaca

SEQ ID NO: 40035 - RNA, 20 nt, Homo sapiens
gccagcccgaggaguggagc

SEQ ID NO: 40036 - RNA, 15 nt, Homo sapiens
gccccccaaaggcag

SEQ ID NO: 40037 - RNA, 18 nt, Homo sapiens
gcgcagcggcuggccguc

SEQ ID NO: 40038 - RNA, 20 nt, Homo sapiens
ugcugcaagcugggccuugc

SEQ ID NO: 40039 - RNA, 23 nt, Homo sapiens
uggcacuggguguccaacaggau

SEQ ID NO: 40040 - RNA, 19 nt, Homo sapiens
cccuuagaggaggccuaag

SEQ ID NO: 40041 - RNA, 19 nt, Homo sapiens
gggacgugagcugggugau

SEQ ID NO: 40042 - RNA, 20 nt, Homo sapiens
guuccgggcgaggcagcccc

SEQ ID NO: 40043 - RNA, 21 nt, Homo sapiens
agggggaguuggggucucccg

SEQ ID NO: 40044 - RNA, 20 nt, Homo sapiens
cggugguggcucagguggcu

SEQ ID NO: 40045 - RNA, 18 nt, Homo sapiens
ggucuacuguggcagcaa

SEQ ID NO: 40046 - RNA, 20 nt, Homo sapiens
uugcuuggucccaggagcuc

SEQ ID NO: 40047 - RNA, 19 nt, Homo sapiens
gcucgccggccucccgucc

SEQ ID NO: 40048 - RNA, 22 nt, Homo sapiens
aaaagcuaaaaccucagcacaa

SEQ ID NO: 40049 - RNA, 21 nt, Homo sapiens
agaguaccaugaauacacugg

SEQ ID NO: 40050 - RNA, 27 nt, Homo sapiens
ggacugagaggauuuuguagaaggccc

SEQ ID NO: 40051 - RNA, 21 nt, Homo sapiens
uaaauuucuuauagacauuuc

SEQ ID NO: 40052 - RNA, 28 nt, Homo sapiens
ucugcuuuucuuuucuguacagaccucu

SEQ ID NO: 40053 - RNA, 18 nt, Homo sapiens
agaguagacuguguuguu

SEQ ID NO: 40054 - RNA, 20 nt, Homo sapiens
uauaacacaacauugucucc

SEQ ID NO: 40055 - RNA, 16 nt, Homo sapiens
ucaggccacaguauau

SEQ ID NO: 40056 - RNA, 20 nt, Homo sapiens
ucugcagcaaauaaguuugc

SEQ ID NO: 40057 - RNA, 19 nt, Homo sapiens
ucuggaaugcaaauauggu

SEQ ID NO: 40058 - RNA, 19 nt, Homo sapiens
uuggaagauacgugaaaau

SEQ ID NO: 40059 - RNA, 19 nt, Homo sapiens
gcuuuuagucucccuuuuu

SEQ ID NO: 40060 - RNA, 20 nt, Homo sapiens
uaccuaguuacauacauucc

SEQ ID NO: 40061 - RNA, 18 nt, Homo sapiens
ugagugccauacaguaac

SEQ ID NO: 40062 - RNA, 18 nt, Homo sapiens
cacggccccgcuuucacc

SEQ ID NO: 40063 - RNA, 18 nt, Homo sapiens
cccgccgcucccagcgcc

SEQ ID NO: 40064 - RNA, 20 nt, Homo sapiens
cccggcuccgccccccucac

SEQ ID NO: 40065 - RNA, 22 nt, Homo sapiens
ccgccgcggauggacucggauc

SEQ ID NO: 40066 - RNA, 22 nt, Homo sapiens
cucugcaauucucucucugcuu

SEQ ID NO: 40067 - RNA, 21 nt, Homo sapiens
gcgccgccgccgcugcuccgg

SEQ ID NO: 40068 - RNA, 18 nt, Homo sapiens
gcucccggcuccgccccc

SEQ ID NO: 40069 - RNA, 16 nt, Homo sapiens
uacagggcggccacca

SEQ ID NO: 40070 - RNA, 16 nt, Homo sapiens
aaggagcuuuccuuac

SEQ ID NO: 40071 - RNA, 20 nt, Homo sapiens
cccaguggugggggaagggc

SEQ ID NO: 40072 - RNA, 18 nt, Homo sapiens
cgggccccgccgccgccc

SEQ ID NO: 40073 - RNA, 19 nt, Homo sapiens
cgggccccgccgccgcccg

SEQ ID NO: 40074 - RNA, 15 nt, Homo sapiens
gccccgccgccgccc

SEQ ID NO: 40075 - RNA, 20 nt, Homo sapiens
uuagaagugguuaauagaac

SEQ ID NO: 40076 - RNA, 19 nt, Homo sapiens
cagcguccugcaauauccc

SEQ ID NO: 40077 - RNA, 20 nt, Homo sapiens
cauuguguuucuuacaugca

SEQ ID NO: 40078 - RNA, 22 nt, Homo sapiens
aagggaagcugggggugggaag

SEQ ID NO: 40079 - RNA, 23 nt, Homo sapiens
aagggagggaaaauggcaggaag

SEQ ID NO: 40080 - RNA, 15 nt, Homo sapiens
caagaucaacuagcu

SEQ ID NO: 40081 - RNA, 19 nt, Homo sapiens
cagcagccgcgcccgcccc

SEQ ID NO: 40082 - RNA, 18 nt, Homo sapiens
cagcccuaggcgcuuuca

SEQ ID NO: 40083 - RNA, 22 nt, Homo sapiens
ccgcccgggccgccaucuuccc

SEQ ID NO: 40084 - RNA, 16 nt, Homo sapiens
cuccagcccuaggcgc

SEQ ID NO: 40085 - RNA, 20 nt, Homo sapiens
gcccgccuguucccccggcc

SEQ ID NO: 40086 - RNA, 16 nt, Homo sapiens
gcucgcaggagccuga

SEQ ID NO: 40087 - RNA, 21 nt, Homo sapiens
gguccugcugcuaccugaggg

SEQ ID NO: 40088 - RNA, 25 nt, Homo sapiens
ugaggaggggguggggaagcagggg

SEQ ID NO: 40089 - RNA, 19 nt, Homo sapiens
ugaggcccaauccauucca

SEQ ID NO: 40090 - RNA, 21 nt, Homo sapiens
uggggcucugaaagggaaagg

SEQ ID NO: 40091 - RNA, 15 nt, Homo sapiens
uuugucaguucugug

SEQ ID NO: 40092 - RNA, 20 nt, Homo sapiens
accuggaauuacuccaacag

SEQ ID NO: 40093 - RNA, 16 nt, Homo sapiens
agcugggucccauugc

SEQ ID NO: 40094 - RNA, 20 nt, Homo sapiens
aggaaggauuaggccaaggc

SEQ ID NO: 40095 - RNA, 18 nt, Homo sapiens
aguauucagccuggggcu

SEQ ID NO: 40096 - RNA, 19 nt, Homo sapiens
cacccguaguggaaagggg

SEQ ID NO: 40097 - RNA, 19 nt, Homo sapiens
ccuccugucccugcuucuc

SEQ ID NO: 40098 - RNA, 16 nt, Homo sapiens
gaaggauccuuuggcu

SEQ ID NO: 40099 - RNA, 19 nt, Homo sapiens
gaugagccgguugagaaag

SEQ ID NO: 40100 - RNA, 19 nt, Homo sapiens
gcaaguugcacgguggcaa

SEQ ID NO: 40101 - RNA, 19 nt, Homo sapiens
gcccaaauguguucugagu

SEQ ID NO: 40102 - RNA, 18 nt, Homo sapiens
gcucccggcugcccggcc

SEQ ID NO: 40103 - RNA, 18 nt, Homo sapiens
gguccugggggcugucuc

SEQ ID NO: 40104 - RNA, 22 nt, Homo sapiens
gucccugaguauucagccuggg

SEQ ID NO: 40105 - RNA, 18 nt, Homo sapiens
uaauauauauauauauau

SEQ ID NO: 40106 - RNA, 27 nt, Homo sapiens
uaauauauauauauauauguucucauu

SEQ ID NO: 40107 - RNA, 19 nt, Homo sapiens
ucucaggggcuucucuggc

SEQ ID NO: 40108 - RNA, 18 nt, Homo sapiens
ugaagauugauguugggc

SEQ ID NO: 40109 - RNA, 19 nt, Homo sapiens
ugagaaaguggacacuucc

SEQ ID NO: 40110 - RNA, 15 nt, Homo sapiens
ugccaugggugagcc

SEQ ID NO: 40111 - RNA, 19 nt, Homo sapiens
ugccccagggaugccaggc

SEQ ID NO: 40112 - RNA, 19 nt, Homo sapiens
ugcccggccuugguccucc

SEQ ID NO: 40113 - RNA, 20 nt, Homo sapiens
uggagggcuuauaucuugga

SEQ ID NO: 40114 - RNA, 19 nt, Homo sapiens
uggauaggccgaaggaggg

SEQ ID NO: 40115 - RNA, 16 nt, Homo sapiens
uggcaaaaaagcauac

SEQ ID NO: 40116 - RNA, 18 nt, Homo sapiens
uggccuugcaagaugagg

SEQ ID NO: 40117 - RNA, 20 nt, Homo sapiens
ugggagaggcauuuugcuug

SEQ ID NO: 40118 - RNA, 18 nt, Homo sapiens
ugggucccauugccaccu

SEQ ID NO: 40119 - RNA, 22 nt, Homo sapiens
aggcaggcaggcaggcaggccg

SEQ ID NO: 40120 - RNA, 18 nt, Homo sapiens
gggccuucuccccaggcu

SEQ ID NO: 40121 - RNA, 23 nt, Homo sapiens
aauauagaauccuuugugcauuc

SEQ ID NO: 40122 - RNA, 20 nt, Homo sapiens
ccauuuuagaaguaaacuag

SEQ ID NO: 40123 - RNA, 19 nt, Homo sapiens
cccaaagucauuuagaaug

SEQ ID NO: 40124 - RNA, 16 nt, Homo sapiens
cggcgcgcuaccaagc

SEQ ID NO: 40125 - RNA, 25 nt, Homo sapiens
cugccaccuuuuguuaccacaggcg

SEQ ID NO: 40126 - RNA, 16 nt, Homo sapiens
gguaugaagaacuuug

SEQ ID NO: 40127 - RNA, 18 nt, Homo sapiens
uucccagcuauucaggag

SEQ ID NO: 40128 - RNA, 17 nt, Homo sapiens
uugggaggcuaaggugg

SEQ ID NO: 40129 - RNA, 19 nt, Homo sapiens
uuuaaauuggggccaggca

SEQ ID NO: 40130 - RNA, 18 nt, Homo sapiens
gagguggagagggaggcu

SEQ ID NO: 40131 - RNA, 14 nt, Homo sapiens
ggugggucugaggc

SEQ ID NO: 40132 - RNA, 18 nt, Homo sapiens
ucgcaaacagccuggccc

SEQ ID NO: 40133 - RNA, 22 nt, Homo sapiens
aaguuucuuaaaauguuauuuu

SEQ ID NO: 40134 - RNA, 20 nt, Homo sapiens
acaucuuaaggaaagaaaau

SEQ ID NO: 40135 - RNA, 20 nt, Homo sapiens
cagguagcccccaaauguau

SEQ ID NO: 40136 - RNA, 20 nt, Homo sapiens
ccgguuucacuacagcagca

SEQ ID NO: 40137 - RNA, 19 nt, Homo sapiens
cgaggugaggcggcgcugg

SEQ ID NO: 40138 - RNA, 20 nt, Homo sapiens
cuuauaguucaguuuuggag

SEQ ID NO: 40139 - RNA, 18 nt, Homo sapiens
cuugcgcucgggucgcgg

SEQ ID NO: 40140 - RNA, 19 nt, Homo sapiens
cuugcgcucgggucgcgga

SEQ ID NO: 40141 - RNA, 18 nt, Homo sapiens
cuuuacaagguuuguuca

SEQ ID NO: 40142 - RNA, 22 nt, Homo sapiens
gccggaggcgccaggccuccuc

SEQ ID NO: 40143 - RNA, 26 nt, Homo sapiens
gggccugugaauauagaucccucagg

SEQ ID NO: 40144 - RNA, 18 nt, Homo sapiens
uaaaaaaagaaaaaaaaa

SEQ ID NO: 40145 - RNA, 21 nt, Homo sapiens
uccugcaguuuugugcuuuuu

SEQ ID NO: 40146 - RNA, 18 nt, Homo sapiens
aagaaacaaaaccauugu

SEQ ID NO: 40147 - RNA, 26 nt, Homo sapiens
agcccgccccgggucgucgguggccc

SEQ ID NO: 40148 - RNA, 17 nt, Homo sapiens
aggggaaggagagcugc

SEQ ID NO: 40149 - RNA, 18 nt, Homo sapiens
cagggucugcaggccgcc

SEQ ID NO: 40150 - RNA, 16 nt, Homo sapiens
cguucaugucuucuca

SEQ ID NO: 40151 - RNA, 20 nt, Homo sapiens
ggcucuggaggaggggcccc

SEQ ID NO: 40152 - RNA, 19 nt, Homo sapiens
guggggguggccugcagac

SEQ ID NO: 40153 - RNA, 20 nt, Homo sapiens
uaagaaaauaagaaagugca

SEQ ID NO: 40154 - RNA, 22 nt, Homo sapiens
ucgucccuguggcucccacccc

SEQ ID NO: 40155 - RNA, 21 nt, Homo sapiens
ucugaauagucuggguucagg

SEQ ID NO: 40156 - RNA, 15 nt, Homo sapiens
ugggagagcagcggc

SEQ ID NO: 40157 - RNA, 21 nt, Homo sapiens
acggacgggacgggagcccgg

SEQ ID NO: 40158 - RNA, 23 nt, Homo sapiens
aggacagacagaaugcaggaaaa

SEQ ID NO: 40159 - RNA, 16 nt, Homo sapiens
agggagacaaagcaag

SEQ ID NO: 40160 - RNA, 17 nt, Homo sapiens
caccgacuucccguucc

SEQ ID NO: 40161 - RNA, 21 nt, Homo sapiens
cagcccccuccuggucuuagc

SEQ ID NO: 40162 - RNA, 22 nt, Homo sapiens
ccauauccagggagacaaagca

SEQ ID NO: 40163 - RNA, 15 nt, Homo sapiens
cccguucccuccuca

SEQ ID NO: 40164 - RNA, 14 nt, Homo sapiens
ccugggaaagagaa

SEQ ID NO: 40165 - RNA, 24 nt, Homo sapiens
cgggcggcggcggcagcagcggcg

SEQ ID NO: 40166 - RNA, 18 nt, Homo sapiens
gaggggguggagcugcgg

SEQ ID NO: 40167 - RNA, 19 nt, Homo sapiens
gcagcguagaggagcagga

SEQ ID NO: 40168 - RNA, 20 nt, Homo sapiens
gccuuguaggcccacagccc

SEQ ID NO: 40169 - RNA, 21 nt, Homo sapiens
gcggcggcggcagcagcggcg

SEQ ID NO: 40170 - RNA, 24 nt, Homo sapiens
gcugcggcucgagcuccggcuucg

SEQ ID NO: 40171 - RNA, 22 nt, Homo sapiens
gcugguggucagcaaagggagc

SEQ ID NO: 40172 - RNA, 21 nt, Homo sapiens
ggacgaaagaaggggaaaggg

SEQ ID NO: 40173 - RNA, 15 nt, Homo sapiens
ucacucggggggccc

SEQ ID NO: 40174 - RNA, 21 nt, Homo sapiens
ucugggcccccgugcccaccu

SEQ ID NO: 40175 - RNA, 19 nt, Homo sapiens
cacucucgugguuuauguc

SEQ ID NO: 40176 - RNA, 21 nt, Homo sapiens
ggccagcaggcuggcucuggc

SEQ ID NO: 40177 - RNA, 20 nt, Homo sapiens
uuuacagaaaugccaacagc

SEQ ID NO: 40178 - RNA, 20 nt, Homo sapiens
agcacaagagggcuggaggg

SEQ ID NO: 40179 - RNA, 18 nt, Homo sapiens
cuauggaugggaaucagg

SEQ ID NO: 40180 - RNA, 19 nt, Homo sapiens
gaaccccugaccucaugau

SEQ ID NO: 40181 - RNA, 18 nt, Homo sapiens
gggaaagcacaagagggc

SEQ ID NO: 40182 - RNA, 19 nt, Homo sapiens
agaagguuggaaacuaaag

SEQ ID NO: 40183 - RNA, 21 nt, Homo sapiens
agccaggcggcgcggcggccg

SEQ ID NO: 40184 - RNA, 18 nt, Homo sapiens
cggcgcggcggccggagc

SEQ ID NO: 40185 - RNA, 18 nt, Homo sapiens
gcaauuucacuauggauc

SEQ ID NO: 40186 - RNA, 16 nt, Homo sapiens
agacugcucauuuccu

SEQ ID NO: 40187 - RNA, 18 nt, Homo sapiens
aucuccuggguucaguuc

SEQ ID NO: 40188 - RNA, 18 nt, Homo sapiens
caagauugggugacuacc

SEQ ID NO: 40189 - RNA, 18 nt, Homo sapiens
cacugcuucugccccccg

SEQ ID NO: 40190 - RNA, 17 nt, Homo sapiens
ccccgcucuguagcucc

SEQ ID NO: 40191 - RNA, 20 nt, Homo sapiens
ccugacucccuaaguguugg

SEQ ID NO: 40192 - RNA, 26 nt, Homo sapiens
cugcaauuuaauuuuaaaucagaguu

SEQ ID NO: 40193 - RNA, 17 nt, Homo sapiens
cugugcugcugugaaac

SEQ ID NO: 40194 - RNA, 18 nt, Homo sapiens
gcagugcauauagcuguu

SEQ ID NO: 40195 - RNA, 20 nt, Homo sapiens
gggauggucggggaucaggg

SEQ ID NO: 40196 - RNA, 17 nt, Homo sapiens
gggcuggggcaggggcu

SEQ ID NO: 40197 - RNA, 16 nt, Homo sapiens
guaggccaccccgcuc

SEQ ID NO: 40198 - RNA, 18 nt, Homo sapiens
ucacaaagucaugucugu

SEQ ID NO: 40199 - RNA, 18 nt, Homo sapiens
uccaugggcagauggaac

SEQ ID NO: 40200 - RNA, 19 nt, Homo sapiens
uggcccaggccaucuucag

SEQ ID NO: 40201 - RNA, 18 nt, Homo sapiens
uuccacugucuccacccu

SEQ ID NO: 40202 - RNA, 23 nt, Homo sapiens
uuccuguccucgguucuuuuccg

SEQ ID NO: 40203 - RNA, 18 nt, Homo sapiens
ggguugaaguccuucgac

SEQ ID NO: 40204 - RNA, 18 nt, Homo sapiens
ucucuuuauugagguucu

SEQ ID NO: 40205 - RNA, 19 nt, Homo sapiens
aaagguuuuauaugaaagg

SEQ ID NO: 40206 - RNA, 17 nt, Homo sapiens
cacacuaggacaggauu

SEQ ID NO: 40207 - RNA, 20 nt, Homo sapiens
cuguauaaaggcuuuuaucc

SEQ ID NO: 40208 - RNA, 20 nt, Homo sapiens
ucacugcagagaaccaccuc

SEQ ID NO: 40209 - RNA, 18 nt, Homo sapiens
ucucuuucuucucaaccc

SEQ ID NO: 40210 - RNA, 19 nt, Homo sapiens
uuaaguaugauaagugggc

SEQ ID NO: 40211 - RNA, 19 nt, Homo sapiens
uuuuugccacucuaaauau

SEQ ID NO: 40212 - RNA, 15 nt, Homo sapiens
agaaggaaaacuguc

SEQ ID NO: 40213 - RNA, 20 nt, Homo sapiens
cgcggcggugcagccucucc

SEQ ID NO: 40214 - RNA, 20 nt, Homo sapiens
cucuuaaucuacuuuuugug

SEQ ID NO: 40215 - RNA, 20 nt, Homo sapiens
gccucucccgagcgcgcugg

SEQ ID NO: 40216 - RNA, 22 nt, Homo sapiens
gcgggggcgcggcggugcagcc

SEQ ID NO: 40217 - RNA, 19 nt, Homo sapiens
uaggcgggggcgcggcggu

SEQ ID NO: 40218 - RNA, 19 nt, Homo sapiens
ucagaguaacugauguuuc

SEQ ID NO: 40219 - RNA, 26 nt, Homo sapiens
ugucuggaaaaaguacaggagagaga

SEQ ID NO: 40220 - RNA, 19 nt, Homo sapiens
uuucacagguaaaccaaug

SEQ ID NO: 40221 - RNA, 18 nt, Homo sapiens
acgaacaggugcccggca

SEQ ID NO: 40222 - RNA, 14 nt, Homo sapiens
agaaggcagugcca

SEQ ID NO: 40223 - RNA, 25 nt, Homo sapiens
ccaguuggacuguaacuugucaccu

SEQ ID NO: 40224 - RNA, 19 nt, Homo sapiens
cccaauuucaacagugcaa

SEQ ID NO: 40225 - RNA, 21 nt, Homo sapiens
gcuggucgaggcugcgcagcg

SEQ ID NO: 40226 - RNA, 17 nt, Homo sapiens
ggaguccgcgcgccgcc

SEQ ID NO: 40227 - RNA, 17 nt, Homo sapiens
ucgccaccaggccccgu

SEQ ID NO: 40228 - RNA, 18 nt, Homo sapiens
uguaagcuguacaaguag

SEQ ID NO: 40229 - RNA, 18 nt, Homo sapiens
aaagugcccagauugcuc

SEQ ID NO: 40230 - RNA, 15 nt, Homo sapiens
acacauccuuauuug

SEQ ID NO: 40231 - RNA, 23 nt, Homo sapiens
uaaaagugcccagauugcucaaa

SEQ ID NO: 40232 - RNA, 23 nt, Homo sapiens
uccuuauuugcauuuagauaaaa

SEQ ID NO: 40233 - RNA, 21 nt, Homo sapiens
cacccagaagggagaugugcc

SEQ ID NO: 40234 - RNA, 20 nt, Homo sapiens
guuuucuuguugauuuggau

SEQ ID NO: 40235 - RNA, 22 nt, Homo sapiens
aaaacuugagauauuuauugca

SEQ ID NO: 40236 - RNA, 19 nt, Homo sapiens
aaaguauuuuucuuaacaa

SEQ ID NO: 40237 - RNA, 22 nt, Homo sapiens
agauauuuauugcauaguagcu

SEQ ID NO: 40238 - RNA, 21 nt, Homo sapiens
cagaguacuugcuuuuacuuc

SEQ ID NO: 40239 - RNA, 18 nt, Homo sapiens
cccauaggaauauuucca

SEQ ID NO: 40240 - RNA, 19 nt, Homo sapiens
gacacauaaauauaaaaaa

SEQ ID NO: 40241 - RNA, 16 nt, Homo sapiens
gaccguucagcaugga

SEQ ID NO: 40242 - RNA, 17 nt, Homo sapiens
gcugcguguacauauuc

SEQ ID NO: 40243 - RNA, 18 nt, Homo sapiens
uaaugaaguuacauguau

SEQ ID NO: 40244 - RNA, 23 nt, Homo sapiens
uauauauuucccuuacauauaau

SEQ ID NO: 40245 - RNA, 22 nt, Homo sapiens
uccauugaguuauuuauggcaa

SEQ ID NO: 40246 - RNA, 20 nt, Homo sapiens
ucuagacaaaaaaaaaagaa

SEQ ID NO: 40247 - RNA, 20 nt, Homo sapiens
uggaguucuaaaaauauuuu

SEQ ID NO: 40248 - RNA, 21 nt, Homo sapiens
uggaguucuaaaaauauuuuu

SEQ ID NO: 40249 - RNA, 20 nt, Homo sapiens
uguauauauuucccuuacau

SEQ ID NO: 40250 - RNA, 17 nt, Homo sapiens
uuuucauauuuucccac

SEQ ID NO: 40251 - RNA, 18 nt, Homo sapiens
cagcaggcccagaacaca

SEQ ID NO: 40252 - RNA, 23 nt, Homo sapiens
gagaggggcagggagcccacucu

SEQ ID NO: 40253 - RNA, 24 nt, Homo sapiens
gcccacucugcagcccaccuggcc

SEQ ID NO: 40254 - RNA, 21 nt, Homo sapiens
gggcgguggucggggaaucag

SEQ ID NO: 40255 - RNA, 18 nt, Homo sapiens
auauauauauguauauac

SEQ ID NO: 40256 - RNA, 16 nt, Homo sapiens
auauguauauacugua

SEQ ID NO: 40257 - RNA, 26 nt, Homo sapiens
uaacaaauauauauguauauauauau

SEQ ID NO: 40258 - RNA, 21 nt, Homo sapiens
uauauacacacauauguauau

SEQ ID NO: 40259 - RNA, 24 nt, Homo sapiens
uauauacacacauauguauauaua

SEQ ID NO: 40260 - RNA, 24 nt, Homo sapiens
uauauacuguauauacacacauau

SEQ ID NO: 40261 - RNA, 25 nt, Homo sapiens
uauauauauguauauacuguauaua

SEQ ID NO: 40262 - RNA, 18 nt, Homo sapiens
acgggggugggggcaggg

SEQ ID NO: 40263 - RNA, 19 nt, Homo sapiens
agaggaucuuccuuguagg

SEQ ID NO: 40264 - RNA, 20 nt, Homo sapiens
aggugaaacucagacauugu

SEQ ID NO: 40265 - RNA, 19 nt, Homo sapiens
aguccuucuccaggcuuug

SEQ ID NO: 40266 - RNA, 18 nt, Homo sapiens
caaggcauaggacuaaca

SEQ ID NO: 40267 - RNA, 14 nt, Homo sapiens
caccauaaaugggg

SEQ ID NO: 40268 - RNA, 19 nt, Homo sapiens
caugaaaacaccaccaucu

SEQ ID NO: 40269 - RNA, 20 nt, Homo sapiens
ccccuuccuguguccaugcg

SEQ ID NO: 40270 - RNA, 22 nt, Homo sapiens
ccggcuccgcuucgccuggccg

SEQ ID NO: 40271 - RNA, 19 nt, Homo sapiens
ccuccucacagccaccacc

SEQ ID NO: 40272 - RNA, 16 nt, Homo sapiens
cuuuaugagaggugag

SEQ ID NO: 40273 - RNA, 20 nt, Homo sapiens
gaauuaaggggccaguccac

SEQ ID NO: 40274 - RNA, 18 nt, Homo sapiens
gaggcugucccuuuccug

SEQ ID NO: 40275 - RNA, 22 nt, Homo sapiens
ggagugggguuaguguugggga

SEQ ID NO: 40276 - RNA, 20 nt, Homo sapiens
gggccugugggaauuaaggg

SEQ ID NO: 40277 - RNA, 20 nt, Homo sapiens
gggggcagggggcgccuucu

SEQ ID NO: 40278 - RNA, 19 nt, Homo sapiens
gucaaauucuccacgggga

SEQ ID NO: 40279 - RNA, 19 nt, Homo sapiens
uacaccccauuaaaucaaa

SEQ ID NO: 40280 - RNA, 21 nt, Homo sapiens
uagggugacacgggggugggg

SEQ ID NO: 40281 - RNA, 16 nt, Homo sapiens
ucccaggugucuccag

SEQ ID NO: 40282 - RNA, 27 nt, Homo sapiens
uccccaggcugugugcagggauggcag

SEQ ID NO: 40283 - RNA, 18 nt, Homo sapiens
ucccuacucccaccccca

SEQ ID NO: 40284 - RNA, 20 nt, Homo sapiens
uccuggcuguguccucagga

SEQ ID NO: 40285 - RNA, 21 nt, Homo sapiens
ugagucagaugcuuugagggu

SEQ ID NO: 40286 - RNA, 22 nt, Homo sapiens
ugccacucacuagcucgugcgu

SEQ ID NO: 40287 - RNA, 19 nt, Homo sapiens
uggggaugcguuucuuggg

SEQ ID NO: 40288 - RNA, 16 nt, Homo sapiens
auuucaaaacaucucc

SEQ ID NO: 40289 - RNA, 19 nt, Homo sapiens
caagaacaacugaugacga

SEQ ID NO: 40290 - RNA, 21 nt, Homo sapiens
ccggcuccgcuucgccuggcc

SEQ ID NO: 40291 - RNA, 18 nt, Homo sapiens
uccgucccgcaccgcaca

SEQ ID NO: 40292 - RNA, 21 nt, Homo sapiens
ugggccuggcuaucuagaaac

SEQ ID NO: 40293 - RNA, 21 nt, Homo sapiens
agggagggagaggggaggggc

SEQ ID NO: 40294 - RNA, 22 nt, Homo sapiens
ccgcggucggcgccccccgccc

SEQ ID NO: 40295 - RNA, 14 nt, Homo sapiens
gcaagcaugguggc

SEQ ID NO: 40296 - RNA, 17 nt, Homo sapiens
gccccccgcccgccccc

SEQ ID NO: 40297 - RNA, 19 nt, Homo sapiens
gccgcgcguccagaccggc

SEQ ID NO: 40298 - RNA, 17 nt, Homo sapiens
gcgcggggagaucuugc

SEQ ID NO: 40299 - RNA, 23 nt, Homo sapiens
gcggagcgugcgccggacgggcg

SEQ ID NO: 40300 - RNA, 21 nt, Homo sapiens
ggccccacccacagcagcugc

SEQ ID NO: 40301 - RNA, 21 nt, Homo sapiens
ggggaggggccgggccucagg

SEQ ID NO: 40302 - RNA, 16 nt, Homo sapiens
uccucuugauuucccu

SEQ ID NO: 40303 - RNA, 23 nt, Homo sapiens
aaacagacauaguuacaaagagc

SEQ ID NO: 40304 - RNA, 18 nt, Homo sapiens
agggguguugcuucucca

SEQ ID NO: 40305 - RNA, 20 nt, Homo sapiens
cagcccccugcagccuggug

SEQ ID NO: 40306 - RNA, 17 nt, Homo sapiens
cgaggcgccgcggccug

SEQ ID NO: 40307 - RNA, 17 nt, Homo sapiens
cgcgaggcgccgcggcc

SEQ ID NO: 40308 - RNA, 16 nt, Homo sapiens
cggaggaagcgggggc

SEQ ID NO: 40309 - RNA, 23 nt, Homo sapiens
cuggugucuuccugccacccgcc

SEQ ID NO: 40310 - RNA, 19 nt, Homo sapiens
gcacaggagguagggagcu

SEQ ID NO: 40311 - RNA, 17 nt, Homo sapiens
gcuccggggaccgcggc

SEQ ID NO: 40312 - RNA, 21 nt, Homo sapiens
ggcccguggacuccgcagccc

SEQ ID NO: 40313 - RNA, 14 nt, Homo sapiens
gggaaagcgcgagg

SEQ ID NO: 40314 - RNA, 22 nt, Homo sapiens
gggccaagggccccaccgggug

SEQ ID NO: 40315 - RNA, 20 nt, Homo sapiens
gucggggagugggggaaagc

SEQ ID NO: 40316 - RNA, 20 nt, Homo sapiens
ucucucgguccucuggggcc

SEQ ID NO: 40317 - RNA, 20 nt, Homo sapiens
ucuuccugccacccgccggc

SEQ ID NO: 40318 - RNA, 20 nt, Homo sapiens
ugagaggcacacugagcaag

SEQ ID NO: 40319 - RNA, 16 nt, Homo sapiens
ugccacaggccaggcg

SEQ ID NO: 40320 - RNA, 19 nt, Homo sapiens
gcgccgccgccgccgccgg

SEQ ID NO: 40321 - RNA, 17 nt, Homo sapiens
cggagccgcucuggagc

SEQ ID NO: 40322 - RNA, 17 nt, Homo sapiens
cuggagccuggcuggac

SEQ ID NO: 40323 - RNA, 24 nt, Homo sapiens
gggucacgccgcuccucaggugcc

SEQ ID NO: 40324 - RNA, 18 nt, Homo sapiens
uccugccuucccucuucg

SEQ ID NO: 40325 - RNA, 19 nt, Homo sapiens
ugagaggagguggcuuggc

SEQ ID NO: 40326 - RNA, 20 nt, Homo sapiens
ccugcuccuccuccuucucc

SEQ ID NO: 40327 - RNA, 20 nt, Homo sapiens
ugguauagacgccagguuug

SEQ ID NO: 40328 - RNA, 21 nt, Homo sapiens
aggggccaggcuuacagggcu

SEQ ID NO: 40329 - RNA, 23 nt, Homo sapiens
aucucaggcuggcccuggacccc

SEQ ID NO: 40330 - RNA, 24 nt, Homo sapiens
ccguggcuccugccuccacucacc

SEQ ID NO: 40331 - RNA, 21 nt, Homo sapiens
ccugcuggugucacuuggggu

SEQ ID NO: 40332 - RNA, 23 nt, Homo sapiens
cgcgagggaggugcagccuccuc

SEQ ID NO: 40333 - RNA, 19 nt, Homo sapiens
ggcagguggcugaggccug

SEQ ID NO: 40334 - RNA, 17 nt, Homo sapiens
ggggccagggccggccu

SEQ ID NO: 40335 - RNA, 21 nt, Homo sapiens
ucauuuguuucuuuauucaau

SEQ ID NO: 40336 - RNA, 18 nt, Homo sapiens
ucccccacgguggugccc

SEQ ID NO: 40337 - RNA, 21 nt, Homo sapiens
uggaggggcagcccuggggga

SEQ ID NO: 40338 - RNA, 22 nt, Homo sapiens
ugggaggaggcaggcuuguggc

SEQ ID NO: 40339 - RNA, 20 nt, Homo sapiens
uggggaggccuaaguuuuuc

SEQ ID NO: 40340 - RNA, 18 nt, Homo sapiens
uugcuuuccuccugccuu

SEQ ID NO: 40341 - RNA, 23 nt, Homo sapiens
agcgggggggaaugcgaggaaca

SEQ ID NO: 40342 - RNA, 21 nt, Homo sapiens
gcgcuccggcgccauggccgc

SEQ ID NO: 40343 - RNA, 18 nt, Homo sapiens
guuaagugguugcugguu

SEQ ID NO: 40344 - RNA, 19 nt, Homo sapiens
uggcaucucucuuguaguu

SEQ ID NO: 40345 - RNA, 21 nt, Homo sapiens
gagagacauaaaaauaaaaau

SEQ ID NO: 40346 - RNA, 16 nt, Homo sapiens
uaacagacaaauuggc

SEQ ID NO: 40347 - RNA, 18 nt, Homo sapiens
uguuugaagaaauaucca

SEQ ID NO: 40348 - RNA, 17 nt, Homo sapiens
uucuguaucuuaagcuu

SEQ ID NO: 40349 - RNA, 17 nt, Homo sapiens
acagcuucugccuggcc

SEQ ID NO: 40350 - RNA, 19 nt, Homo sapiens
ccucccuuuuauggcagca

SEQ ID NO: 40351 - RNA, 20 nt, Homo sapiens
ggacacagccaguggggggu

SEQ ID NO: 40352 - RNA, 21 nt, Homo sapiens
guggugugcccucacccagca

SEQ ID NO: 40353 - RNA, 18 nt, Homo sapiens
uagaaagcacuucugugg

SEQ ID NO: 40354 - RNA, 19 nt, Homo sapiens
uggcaguggugugcccuca

SEQ ID NO: 40355 - RNA, 19 nt, Homo sapiens
uuucuaaacucccucccag

SEQ ID NO: 40356 - RNA, 14 nt, Homo sapiens
cacuagucacuguc

SEQ ID NO: 40357 - RNA, 22 nt, Homo sapiens
cagggaagaaccagagaagcca

SEQ ID NO: 40358 - RNA, 15 nt, Homo sapiens
gcuuuggagcgcagc

SEQ ID NO: 40359 - RNA, 22 nt, Homo sapiens
ggaguggggacucggcuggacg

SEQ ID NO: 40360 - RNA, 22 nt, Homo sapiens
ggcgcggagcgcgugcugggua

SEQ ID NO: 40361 - RNA, 18 nt, Homo sapiens
gguggggacaguggcugg

SEQ ID NO: 40362 - RNA, 18 nt, Homo sapiens
aaaaauuuaaaaaaaaaa

SEQ ID NO: 40363 - RNA, 20 nt, Homo sapiens
gcggcggggaggggaagggg

SEQ ID NO: 40364 - RNA, 24 nt, Homo sapiens
gggcugggaaggguccgcacuggg

SEQ ID NO: 40365 - RNA, 16 nt, Homo sapiens
ugcuggccugccccga

SEQ ID NO: 40366 - RNA, 22 nt, Homo sapiens
uuuauagucuuauaguaaaggg

SEQ ID NO: 40367 - RNA, 21 nt, Homo sapiens
uuucuuagaaauacacacggg

SEQ ID NO: 40368 - RNA, 17 nt, Homo sapiens
aggcagaaaaaggaaaa

SEQ ID NO: 40369 - RNA, 20 nt, Homo sapiens
aagcgggguggggcgcaucc

SEQ ID NO: 40370 - RNA, 19 nt, Homo sapiens
agggaaauauaaggggaaa

SEQ ID NO: 40371 - RNA, 18 nt, Homo sapiens
cgcacugcguuaccuguc

SEQ ID NO: 40372 - RNA, 18 nt, Homo sapiens
gcggcgggcaggaugccc

SEQ ID NO: 40373 - RNA, 23 nt, Homo sapiens
gcggcucucgcgaccuccccucc

SEQ ID NO: 40374 - RNA, 20 nt, Homo sapiens
gcgggcgggcugcgcgcccg

SEQ ID NO: 40375 - RNA, 24 nt, Homo sapiens
ggccgcgcgggcgggcugcgcgcc

SEQ ID NO: 40376 - RNA, 15 nt, Homo sapiens
gggggggcaggggcg

SEQ ID NO: 40377 - RNA, 18 nt, Homo sapiens
gggggggcaggggcgggg

SEQ ID NO: 40378 - RNA, 17 nt, Homo sapiens
accacgcagggguguuc

SEQ ID NO: 40379 - RNA, 23 nt, Homo sapiens
ccgcgcccccccgagccccucgc

SEQ ID NO: 40380 - RNA, 20 nt, Homo sapiens
ccggguccuggggucccugg

SEQ ID NO: 40381 - RNA, 18 nt, Homo sapiens
ccguccgccgccgccgcc

SEQ ID NO: 40382 - RNA, 18 nt, Homo sapiens
gcuccggcugggccgucc

SEQ ID NO: 40383 - RNA, 19 nt, Homo sapiens
gggaaaacuaaggcucagg

SEQ ID NO: 40384 - RNA, 24 nt, Homo sapiens
ugugugaggcaaguacuauuaggg

SEQ ID NO: 40385 - RNA, 17 nt, Homo sapiens
acgggucuaggaauuac

SEQ ID NO: 40386 - RNA, 17 nt, Homo sapiens
agcugggcgagcuggac

SEQ ID NO: 40387 - RNA, 20 nt, Homo sapiens
ccccagaagccgggcuuccc

SEQ ID NO: 40388 - RNA, 20 nt, Homo sapiens
ccccagcccugucuccuccc

SEQ ID NO: 40389 - RNA, 21 nt, Homo sapiens
cccucgcucccggacccgccu

SEQ ID NO: 40390 - RNA, 19 nt, Homo sapiens
cgagcugggcgagcuggac

SEQ ID NO: 40391 - RNA, 20 nt, Homo sapiens
cggcagggcgcucccccagc

SEQ ID NO: 40392 - RNA, 17 nt, Homo sapiens
gcccugucuccuccccc

SEQ ID NO: 40393 - RNA, 20 nt, Homo sapiens
gcgcggcgggcugugcgccu

SEQ ID NO: 40394 - RNA, 21 nt, Homo sapiens
gcggagaggcgagcgcggcgg

SEQ ID NO: 40395 - RNA, 20 nt, Homo sapiens
ggaggcggcgcgggagcggg

SEQ ID NO: 40396 - RNA, 21 nt, Homo sapiens
gggaggcggcgcgggagcggg

SEQ ID NO: 40397 - RNA, 23 nt, Homo sapiens
gggaggcggcgcgggagcgggag

SEQ ID NO: 40398 - RNA, 17 nt, Homo sapiens
gguccguugaagccuug

SEQ ID NO: 40399 - RNA, 20 nt, Homo sapiens
ucgcccgccccagacagagc

SEQ ID NO: 40400 - RNA, 19 nt, Homo sapiens
ugggggucucggcggccug

SEQ ID NO: 40401 - RNA, 25 nt, Homo sapiens
uuauuuuuacauuugcuaagugucc

SEQ ID NO: 40402 - RNA, 14 nt, Homo sapiens
acccgcccgcccgc

SEQ ID NO: 40403 - RNA, 21 nt, Homo sapiens
acccgcccgcccgccugcgcc

SEQ ID NO: 40404 - RNA, 24 nt, Homo sapiens
acccugcgggccauggucccuccc

SEQ ID NO: 40405 - RNA, 19 nt, Homo sapiens
cccugccucccguccuggc

SEQ ID NO: 40406 - RNA, 21 nt, Homo sapiens
ccgcccgccugcgccccgccc

SEQ ID NO: 40407 - RNA, 19 nt, Homo sapiens
ccgcgcgcucagggcccgg

SEQ ID NO: 40408 - RNA, 18 nt, Homo sapiens
ccucccuguggcagcugu

SEQ ID NO: 40409 - RNA, 20 nt, Homo sapiens
cucccguccuggcccccacg

SEQ ID NO: 40410 - RNA, 21 nt, Homo sapiens
cuuccggucccgucgacggcc

SEQ ID NO: 40411 - RNA, 16 nt, Homo sapiens
gcgccccgcccggccc

SEQ ID NO: 40412 - RNA, 18 nt, Homo sapiens
gcgggccauggucccucc

SEQ ID NO: 40413 - RNA, 19 nt, Homo sapiens
gggccugugcaccgcaggg

SEQ ID NO: 40414 - RNA, 17 nt, Homo sapiens
gggggccagagaagcca

SEQ ID NO: 40415 - RNA, 14 nt, Homo sapiens
uacagcacagacac

SEQ ID NO: 40416 - RNA, 18 nt, Homo sapiens
uccagacagggggccugu

SEQ ID NO: 40417 - RNA, 19 nt, Homo sapiens
ucucucgucuuccgguccc

SEQ ID NO: 40418 - RNA, 17 nt, Homo sapiens
ugggggccagagaagcc

SEQ ID NO: 40419 - RNA, 21 nt, Homo sapiens
ugugcaggaggugggggucag

SEQ ID NO: 40420 - RNA, 17 nt, Homo sapiens
ccccaaccccuuuuccc

SEQ ID NO: 40421 - RNA, 19 nt, Homo sapiens
cccccugagcuggggcaua

SEQ ID NO: 40422 - RNA, 19 nt, Homo sapiens
ccccugcuuuaccucccug

SEQ ID NO: 40423 - RNA, 16 nt, Homo sapiens
gcaccccagagcuggc

SEQ ID NO: 40424 - RNA, 18 nt, Homo sapiens
ugccaccagcccccaagc

SEQ ID NO: 40425 - RNA, 16 nt, Homo sapiens
uggaugaggaagggga

SEQ ID NO: 40426 - RNA, 18 nt, Homo sapiens
aggagaaaagcaaaauaa

SEQ ID NO: 40427 - RNA, 18 nt, Homo sapiens
cacaaacuuuggaucaag

SEQ ID NO: 40428 - RNA, 17 nt, Homo sapiens
ccugcaaccuacaagcc

SEQ ID NO: 40429 - RNA, 19 nt, Homo sapiens
gcuauguauuuacauuuuc

SEQ ID NO: 40430 - RNA, 23 nt, Homo sapiens
uccuaagcuuuuuuuuuucugcu

SEQ ID NO: 40431 - RNA, 21 nt, Homo sapiens
uccuuggugcaauccaguaca

SEQ ID NO: 40432 - RNA, 18 nt, Homo sapiens
ugcauaagcuuaacagua

SEQ ID NO: 40433 - RNA, 21 nt, Homo sapiens
uuuagaaguugagguuaagcc

SEQ ID NO: 40434 - RNA, 23 nt, Homo sapiens
uuucaauguaguuuuagaaguug

SEQ ID NO: 40435 - RNA, 16 nt, Homo sapiens
ggcgcuguccgcugcg

SEQ ID NO: 40436 - RNA, 19 nt, Homo sapiens
cagcagccagugacuucug

SEQ ID NO: 40437 - RNA, 20 nt, Homo sapiens
cgggccuccgucgccugccu

SEQ ID NO: 40438 - RNA, 19 nt, Homo sapiens
guggagguggggacgaugg

SEQ ID NO: 40439 - RNA, 18 nt, Homo sapiens
cagaggggcgggcgcugu

SEQ ID NO: 40440 - RNA, 19 nt, Homo sapiens
cggagagugaucccggggg

SEQ ID NO: 40441 - RNA, 14 nt, Homo sapiens
gcgguaccgggcgg

SEQ ID NO: 40442 - RNA, 20 nt, Homo sapiens
ggagagugaucccggggggu

SEQ ID NO: 40443 - RNA, 18 nt, Homo sapiens
uauagcacacaauagaug

SEQ ID NO: 40444 - RNA, 19 nt, Homo sapiens
agugcagggaaggguaaug

SEQ ID NO: 40445 - RNA, 24 nt, Homo sapiens
cagcaggcugaguaugggcuccuc

SEQ ID NO: 40446 - RNA, 18 nt, Homo sapiens
cgaggaggcaggugcugg

SEQ ID NO: 40447 - RNA, 19 nt, Homo sapiens
uccagcugcgcugcacagc

SEQ ID NO: 40448 - RNA, 20 nt, Homo sapiens
agaagagaaaggacgcaagu

SEQ ID NO: 40449 - RNA, 19 nt, Homo sapiens
ccacgggcacacggcccgg

SEQ ID NO: 40450 - RNA, 18 nt, Homo sapiens
gcaucuguugucuggggu

SEQ ID NO: 40451 - RNA, 18 nt, Homo sapiens
gcggagcgggagacgagg

SEQ ID NO: 40452 - RNA, 18 nt, Homo sapiens
ggcgacagcggcuggagc

SEQ ID NO: 40453 - RNA, 23 nt, Homo sapiens
uauaauaaauaauauauauuaua

SEQ ID NO: 40454 - RNA, 20 nt, Homo sapiens
uuaguaagagaacuacugag

SEQ ID NO: 40455 - RNA, 20 nt, Homo sapiens
aaccucaucauuaauucucu

SEQ ID NO: 40456 - RNA, 18 nt, Homo sapiens
aguccauaucucagcacu

SEQ ID NO: 40457 - RNA, 19 nt, Homo sapiens
cauguaaccucaucauuaa

SEQ ID NO: 40458 - RNA, 20 nt, Homo sapiens
ugagaguuugcaaugucuau

SEQ ID NO: 40459 - RNA, 16 nt, Homo sapiens
ccugcuccauggaagc

SEQ ID NO: 40460 - RNA, 19 nt, Homo sapiens
ucacagguugggguccccg

SEQ ID NO: 40461 - RNA, 23 nt, Homo sapiens
ucauuguguuuacaaauuacauu

SEQ ID NO: 40462 - RNA, 22 nt, Homo sapiens
uucacuugucuuccaaauccca

SEQ ID NO: 40463 - RNA, 16 nt, Homo sapiens
ccgccgccgccucgcc

SEQ ID NO: 40464 - RNA, 16 nt, Homo sapiens
acccagagcuacaagg

SEQ ID NO: 40465 - RNA, 19 nt, Homo sapiens
caucuuuaauuacuuugca

SEQ ID NO: 40466 - RNA, 18 nt, Homo sapiens
ccucaaggucuaggagga

SEQ ID NO: 40467 - RNA, 19 nt, Homo sapiens
ccucuuaugcugaucaccu

SEQ ID NO: 40468 - RNA, 16 nt, Homo sapiens
cuccugcugcgugagc

SEQ ID NO: 40469 - RNA, 16 nt, Homo sapiens
gcaaggcgccucagca

SEQ ID NO: 40470 - RNA, 21 nt, Homo sapiens
uaaagggugaacuugagagcu

SEQ ID NO: 40471 - RNA, 18 nt, Homo sapiens
uaacuaauguagaaagca

SEQ ID NO: 40472 - RNA, 19 nt, Homo sapiens
ucugaauguagguauguau

SEQ ID NO: 40473 - RNA, 27 nt, Homo sapiens
ucuuacugcugugaauuuaaccacagg

SEQ ID NO: 40474 - RNA, 19 nt, Homo sapiens
agggcagagcccgcugggg

SEQ ID NO: 40475 - RNA, 17 nt, Homo sapiens
ggcaguuccccuucugc

SEQ ID NO: 40476 - RNA, 19 nt, Homo sapiens
ugcuguucuuguugcugcu

SEQ ID NO: 40477 - RNA, 16 nt, Homo sapiens
ugugaagcgcaccagg

SEQ ID NO: 40478 - RNA, 20 nt, Homo sapiens
ccuagccucauccugcagca

SEQ ID NO: 40479 - RNA, 15 nt, Homo sapiens
uuccccgccaccgug

SEQ ID NO: 40480 - RNA, 18 nt, Homo sapiens
cgcugcgagccgacugug

SEQ ID NO: 40481 - RNA, 18 nt, Homo sapiens
gggccgggcgggggccgg

SEQ ID NO: 40482 - RNA, 18 nt, Homo sapiens
gggcgggggccgggccgg

SEQ ID NO: 40483 - RNA, 23 nt, Homo sapiens
acagcaguuuugcggcucaaggg

SEQ ID NO: 40484 - RNA, 19 nt, Homo sapiens
acuguccucccaccucccc

SEQ ID NO: 40485 - RNA, 21 nt, Homo sapiens
aggucggggggugagaguguc

SEQ ID NO: 40486 - RNA, 18 nt, Homo sapiens
agguugagauggaaggua

SEQ ID NO: 40487 - RNA, 19 nt, Homo sapiens
cagcuccagaaggccuccu

SEQ ID NO: 40488 - RNA, 15 nt, Homo sapiens
ccccucucugcgugg

SEQ ID NO: 40489 - RNA, 23 nt, Homo sapiens
ccuccgcgccgccaccgguacca

SEQ ID NO: 40490 - RNA, 24 nt, Homo sapiens
uacuaaaugcccauuuguaacuga

SEQ ID NO: 40491 - RNA, 20 nt, Homo sapiens
uccaagguccccacccaggu

SEQ ID NO: 40492 - RNA, 20 nt, Homo sapiens
uccaguaaauaaacauuaug

SEQ ID NO: 40493 - RNA, 18 nt, Homo sapiens
ugccuguaaaauuauaaa

SEQ ID NO: 40494 - RNA, 20 nt, Homo sapiens
uggcuucgccgccacaagcu

SEQ ID NO: 40495 - RNA, 19 nt, Homo sapiens
ugggaggugaagacugcag

SEQ ID NO: 40496 - RNA, 17 nt, Homo sapiens
uugggaggcugaggugg

SEQ ID NO: 40497 - RNA, 18 nt, Homo sapiens
acaaaaaaaguucagagu

SEQ ID NO: 40498 - RNA, 15 nt, Homo sapiens
caacacuggucagca

SEQ ID NO: 40499 - RNA, 21 nt, Homo sapiens
ccuuggcugcccaacagaaaa

SEQ ID NO: 40500 - RNA, 27 nt, Homo sapiens
cucaagaaauuuagauggguuuuugga

SEQ ID NO: 40501 - RNA, 16 nt, Homo sapiens
cucuuaaaguuuguca

SEQ ID NO: 40502 - RNA, 19 nt, Homo sapiens
gccaucuggggacuuuugc

SEQ ID NO: 40503 - RNA, 18 nt, Homo sapiens
guuuagauaaugugcucu

SEQ ID NO: 40504 - RNA, 20 nt, Homo sapiens
uaagugcacagaaaaaagca

SEQ ID NO: 40505 - RNA, 24 nt, Homo sapiens
ugauguuuauuuaucaaaugucaa

SEQ ID NO: 40506 - RNA, 17 nt, Homo sapiens
gaagaugaggccggcag

SEQ ID NO: 40507 - RNA, 21 nt, Homo sapiens
ccgccgcgcaguccccgaccc

SEQ ID NO: 40508 - RNA, 18 nt, Homo sapiens
gccccgacgccgggcgcg

SEQ ID NO: 40509 - RNA, 18 nt, Homo sapiens
gcgcggggaauccgccgc

SEQ ID NO: 40510 - RNA, 18 nt, Homo sapiens
gcgcgcgugcgcucaagg

SEQ ID NO: 40511 - RNA, 19 nt, Homo sapiens
uguaugugugugugugugu

SEQ ID NO: 40512 - RNA, 21 nt, Homo sapiens
uguguaugugugugugugugu

SEQ ID NO: 40513 - RNA, 25 nt, Homo sapiens
cagaaugucaugccacaguccacua

SEQ ID NO: 40514 - RNA, 22 nt, Homo sapiens
cagagugugugugugugugugu

SEQ ID NO: 40515 - RNA, 18 nt, Homo sapiens
ugugugugugugugugug

SEQ ID NO: 40516 - RNA, 19 nt, Homo sapiens
ugugugugugugugugugu

SEQ ID NO: 40517 - RNA, 20 nt, Homo sapiens
aggcugcccgacgugcccgg

SEQ ID NO: 40518 - RNA, 20 nt, Homo sapiens
cacuccggggcuccggcagc

SEQ ID NO: 40519 - RNA, 20 nt, Homo sapiens
caggggugaagcccaggaag

SEQ ID NO: 40520 - RNA, 16 nt, Homo sapiens
cccaguggcaggcggc

SEQ ID NO: 40521 - RNA, 20 nt, Homo sapiens
ccccacuguucuccgauauc

SEQ ID NO: 40522 - RNA, 21 nt, Homo sapiens
ccuauuaaccagccugcuuug

SEQ ID NO: 40523 - RNA, 17 nt, Homo sapiens
cggggcuccggcagcgg

SEQ ID NO: 40524 - RNA, 21 nt, Homo sapiens
gcagggauuucuacuuuuggu

SEQ ID NO: 40525 - RNA, 18 nt, Homo sapiens
gcagguccugggcccggc

SEQ ID NO: 40526 - RNA, 17 nt, Homo sapiens
ggguguuuuauuucuuu

SEQ ID NO: 40527 - RNA, 17 nt, Homo sapiens
gguuccaguccaccucg

SEQ ID NO: 40528 - RNA, 17 nt, Homo sapiens
gugcagggauuucuacu

SEQ ID NO: 40529 - RNA, 20 nt, Homo sapiens
ugaggacuguaguuaggagg

SEQ ID NO: 40530 - RNA, 17 nt, Homo sapiens
ugggcaugauccugcag

SEQ ID NO: 40531 - RNA, 21 nt, Homo sapiens
cauuaagauauuaacaacugg

SEQ ID NO: 40532 - RNA, 19 nt, Homo sapiens
ggcuccgccgagagccgcg

SEQ ID NO: 40533 - RNA, 20 nt, Homo sapiens
aacugcccugaggccuaaga

SEQ ID NO: 40534 - RNA, 18 nt, Homo sapiens
accaaaauuuuugcuuuu

SEQ ID NO: 40535 - RNA, 18 nt, Homo sapiens
accaaguaccuuagagau

SEQ ID NO: 40536 - RNA, 21 nt, Homo sapiens
acgcaggcgcgcgugcgugcg

SEQ ID NO: 40537 - RNA, 19 nt, Homo sapiens
aggagugggagggcagggg

SEQ ID NO: 40538 - RNA, 18 nt, Homo sapiens
aggcaggcucagcgaugg

SEQ ID NO: 40539 - RNA, 25 nt, Homo sapiens
aggggaaggagugggagggcagggg

SEQ ID NO: 40540 - RNA, 17 nt, Homo sapiens
augggcuccgccuucag

SEQ ID NO: 40541 - RNA, 21 nt, Homo sapiens
augggcuccgccuucaguccc

SEQ ID NO: 40542 - RNA, 22 nt, Homo sapiens
cagagcggauggaagaccaccu

SEQ ID NO: 40543 - RNA, 18 nt, Homo sapiens
cggauggaagaccaccuc

SEQ ID NO: 40544 - RNA, 21 nt, Homo sapiens
cgugcgugcggcgggcagcaa

SEQ ID NO: 40545 - RNA, 15 nt, Homo sapiens
cguggcuggcuuucc

SEQ ID NO: 40546 - RNA, 22 nt, Homo sapiens
gagguaggguggggagaaggug

SEQ ID NO: 40547 - RNA, 18 nt, Homo sapiens
gcgagcacgcacacacuc

SEQ ID NO: 40548 - RNA, 20 nt, Homo sapiens
gcgcgcacacacacacacuc

SEQ ID NO: 40549 - RNA, 20 nt, Homo sapiens
gcgcgcgugcgugcggcggg

SEQ ID NO: 40550 - RNA, 18 nt, Homo sapiens
gcgcuccuuacccccucc

SEQ ID NO: 40551 - RNA, 19 nt, Homo sapiens
gcuccuuacccccuccccc

SEQ ID NO: 40552 - RNA, 21 nt, Homo sapiens
ggaggggggagggaagaaggg

SEQ ID NO: 40553 - RNA, 19 nt, Homo sapiens
ggcgcgcgugcgugcggcg

SEQ ID NO: 40554 - RNA, 18 nt, Homo sapiens
gggaaggagugggagggc

SEQ ID NO: 40555 - RNA, 16 nt, Homo sapiens
gggaggggggagggaa

SEQ ID NO: 40556 - RNA, 16 nt, Homo sapiens
ggggagaaggugagac

SEQ ID NO: 40557 - RNA, 24 nt, Homo sapiens
uaacacacguauguagauauaauc

SEQ ID NO: 40558 - RNA, 18 nt, Homo sapiens
ucggggggaggggggagg

SEQ ID NO: 40559 - RNA, 17 nt, Homo sapiens
ucguggggggggugggg

SEQ ID NO: 40560 - RNA, 21 nt, Homo sapiens
ucugcgcuuuggugcgcuccu

SEQ ID NO: 40561 - RNA, 20 nt, Homo sapiens
ugcagguccuuggcgcggcc

SEQ ID NO: 40562 - RNA, 19 nt, Homo sapiens
ugcgugcggcgggcagcaa

SEQ ID NO: 40563 - RNA, 16 nt, Homo sapiens
ugggagggcagggggc

SEQ ID NO: 40564 - RNA, 23 nt, Homo sapiens
uguguguauguuauguauaugua

SEQ ID NO: 40565 - RNA, 22 nt, Homo sapiens
uuaaauucuaucuguuguguug

SEQ ID NO: 40566 - RNA, 19 nt, Homo sapiens
uuugucuuuuuucuaagua

SEQ ID NO: 40567 - RNA, 21 nt, Homo sapiens
cguucaaaaacuugguuauga

SEQ ID NO: 40568 - RNA, 16 nt, Homo sapiens
uaaagaguuuuggguc

SEQ ID NO: 40569 - RNA, 19 nt, Homo sapiens
uguaaacuguguacacaga

SEQ ID NO: 40570 - RNA, 16 nt, Homo sapiens
ugugugaaggguugac

SEQ ID NO: 40571 - RNA, 21 nt, Homo sapiens
uugcuaauguugcauuuucag

SEQ ID NO: 40572 - RNA, 18 nt, Homo sapiens
uuucaacgguugcuggag

SEQ ID NO: 40573 - RNA, 17 nt, Homo sapiens
aaggggccggggaggag

SEQ ID NO: 40574 - RNA, 20 nt, Homo sapiens
cccauccguacucagccucu

SEQ ID NO: 40575 - RNA, 21 nt, Homo sapiens
cccauccguacucagccucuc

SEQ ID NO: 40576 - RNA, 14 nt, Homo sapiens
ccuguuuugccugu

SEQ ID NO: 40577 - RNA, 18 nt, Homo sapiens
cgaguaaccccaauucca

SEQ ID NO: 40578 - RNA, 19 nt, Homo sapiens
gcacccguuugaaccagga

SEQ ID NO: 40579 - RNA, 19 nt, Homo sapiens
ggcagccgcacuggccgcc

SEQ ID NO: 40580 - RNA, 22 nt, Homo sapiens
agauguuguggaugcugcugag

SEQ ID NO: 40581 - RNA, 22 nt, Homo sapiens
aggcggcggcgcugucgggcgg

SEQ ID NO: 40582 - RNA, 17 nt, Homo sapiens
caguggccuaaggugcu

SEQ ID NO: 40583 - RNA, 16 nt, Homo sapiens
gcccuuggacagucag

SEQ ID NO: 40584 - RNA, 19 nt, Homo sapiens
aagaggaaaguggcuuuau

SEQ ID NO: 40585 - RNA, 16 nt, Homo sapiens
cccuaggucugggaga

SEQ ID NO: 40586 - RNA, 21 nt, Homo sapiens
cuaggagaggggaggaggaac

SEQ ID NO: 40587 - RNA, 23 nt, Homo sapiens
gggcugcuaggagaggggaggag

SEQ ID NO: 40588 - RNA, 22 nt, Homo sapiens
ucccuaggucugggagagcggg

SEQ ID NO: 40589 - RNA, 16 nt, Homo sapiens
ugaguagcacccuugg

SEQ ID NO: 40590 - RNA, 21 nt, Homo sapiens
uggaaaguggcaagcuuugga

SEQ ID NO: 40591 - RNA, 23 nt, Homo sapiens
ugggagagcggguuccccauucc

SEQ ID NO: 40592 - RNA, 18 nt, Homo sapiens
ccgcgcgcaagccuggcc

SEQ ID NO: 40593 - RNA, 16 nt, Homo sapiens
gaacugagggaagaug

SEQ ID NO: 40594 - RNA, 25 nt, Homo sapiens
cgggcgggugcgcccgggcgcggcg

SEQ ID NO: 40595 - RNA, 21 nt, Homo sapiens
uauaaucuaaucuauacaaca

SEQ ID NO: 40596 - RNA, 20 nt, Homo sapiens
uauguauauauacaaauaga

SEQ ID NO: 40597 - RNA, 24 nt, Homo sapiens
uccagcgcccagccccgguccccg

SEQ ID NO: 40598 - RNA, 16 nt, Homo sapiens
ccaguggcgggagagc

SEQ ID NO: 40599 - RNA, 18 nt, Homo sapiens
gcucacauucccugcccc

SEQ ID NO: 40600 - RNA, 19 nt, Homo sapiens
agggguggguggggugggg

SEQ ID NO: 40601 - RNA, 20 nt, Homo sapiens
cacagcucagguacccgcca

SEQ ID NO: 40602 - RNA, 17 nt, Homo sapiens
caggaaccuggagagga

SEQ ID NO: 40603 - RNA, 19 nt, Homo sapiens
gagaggaggcuuggauggc

SEQ ID NO: 40604 - RNA, 18 nt, Homo sapiens
gaucugagcguuucucuu

SEQ ID NO: 40605 - RNA, 15 nt, Homo sapiens
ggcccccuucugggg

SEQ ID NO: 40606 - RNA, 22 nt, Homo sapiens
ggcgggacagcagcagcccggg

SEQ ID NO: 40607 - RNA, 21 nt, Homo sapiens
gggagagcagcagcaggaaga

SEQ ID NO: 40608 - RNA, 21 nt, Homo sapiens
ggggagggguggguggggugg

SEQ ID NO: 40609 - RNA, 22 nt, Homo sapiens
ggggaggggugggugggguggg

SEQ ID NO: 40610 - RNA, 18 nt, Homo sapiens
gggguggucugugagccu

SEQ ID NO: 40611 - RNA, 18 nt, Homo sapiens
uccauggcccccuucugg

SEQ ID NO: 40612 - RNA, 23 nt, Homo sapiens
uggcacuccucuccccggggcug

SEQ ID NO: 40613 - RNA, 18 nt, Homo sapiens
cgcgggccugguugcggc

SEQ ID NO: 40614 - RNA, 19 nt, Homo sapiens
gguggcggcgcgggccugg

SEQ ID NO: 40615 - RNA, 22 nt, Homo sapiens
uagaaaaacaaacaaagacaug

SEQ ID NO: 40616 - RNA, 21 nt, Homo sapiens
aggagcugggggagggccggg

SEQ ID NO: 40617 - RNA, 19 nt, Homo sapiens
gagcugggggagggccggg

SEQ ID NO: 40618 - RNA, 21 nt, Homo sapiens
ggggagggccgggcucagggc

SEQ ID NO: 40619 - RNA, 15 nt, Homo sapiens
guagaggugaugggg

SEQ ID NO: 40620 - RNA, 19 nt, Homo sapiens
aggccuguccccucacagc

SEQ ID NO: 40621 - RNA, 19 nt, Homo sapiens
ccuggcuggggccagcccc

SEQ ID NO: 40622 - RNA, 21 nt, Homo sapiens
cugcccuucucagcucugcca

SEQ ID NO: 40623 - RNA, 17 nt, Homo sapiens
ggggcagcaaagugagg

SEQ ID NO: 40624 - RNA, 19 nt, Homo sapiens
gggggucauggcuggauuc

SEQ ID NO: 40625 - RNA, 25 nt, Homo sapiens
uacaaaaaaccauggcuucucugga

SEQ ID NO: 40626 - RNA, 19 nt, Homo sapiens
uaccagacuggcaccuaag

SEQ ID NO: 40627 - RNA, 16 nt, Homo sapiens
ugagcugacuucagcc

SEQ ID NO: 40628 - RNA, 20 nt, Homo sapiens
ugagcugacuucagccuggu

SEQ ID NO: 40629 - RNA, 16 nt, Homo sapiens
uggcaugagcuggugc

SEQ ID NO: 40630 - RNA, 19 nt, Homo sapiens
uguuugaaggcagagucca

SEQ ID NO: 40631 - RNA, 16 nt, Homo sapiens
cagcccuagcuccugc

SEQ ID NO: 40632 - RNA, 17 nt, Homo sapiens
cauuuuggucagcccca

SEQ ID NO: 40633 - RNA, 17 nt, Homo sapiens
cuuggagcugaggcagc

SEQ ID NO: 40634 - RNA, 18 nt, Homo sapiens
ggaguggggcuggggagg

SEQ ID NO: 40635 - RNA, 21 nt, Homo sapiens
ggggguggggugagggguggg

SEQ ID NO: 40636 - RNA, 17 nt, Homo sapiens
gggguggggugaggggg

SEQ ID NO: 40637 - RNA, 18 nt, Homo sapiens
gggguggggugaggggug

SEQ ID NO: 40638 - RNA, 19 nt, Homo sapiens
gggguggggugaggggugg

SEQ ID NO: 40639 - RNA, 19 nt, Homo sapiens
ggguggggugagggguggg

SEQ ID NO: 40640 - RNA, 18 nt, Homo sapiens
gguggggugagggguggg

SEQ ID NO: 40641 - RNA, 18 nt, Homo sapiens
guggggguggggugaggg

SEQ ID NO: 40642 - RNA, 18 nt, Homo sapiens
ugaauggggaaaacagag

SEQ ID NO: 40643 - RNA, 25 nt, Homo sapiens
uggagaugaauggggaaaacagagg

SEQ ID NO: 40644 - RNA, 18 nt, Homo sapiens
cuuuucgccugcaucucg

SEQ ID NO: 40645 - RNA, 15 nt, Homo sapiens
gcagaucagucugga

SEQ ID NO: 40646 - RNA, 20 nt, Homo sapiens
auuggugcaccagaauccag

SEQ ID NO: 40647 - RNA, 18 nt, Homo sapiens
caggaucuuuugcacccc

SEQ ID NO: 40648 - RNA, 17 nt, Homo sapiens
ccaccaaaaagcccaau

SEQ ID NO: 40649 - RNA, 17 nt, Homo sapiens
ggaccgccgucggagcg

SEQ ID NO: 40650 - RNA, 18 nt, Homo sapiens
ggcagcgacgcugaaggg

SEQ ID NO: 40651 - RNA, 18 nt, Homo sapiens
uucugcccaaagucucag

SEQ ID NO: 40652 - RNA, 18 nt, Homo sapiens
caccagagacuguugaac

SEQ ID NO: 40653 - RNA, 17 nt, Homo sapiens
ccgaaaguuuagacagg

SEQ ID NO: 40654 - RNA, 17 nt, Homo sapiens
cuucucuuuuuguauuc

SEQ ID NO: 40655 - RNA, 18 nt, Homo sapiens
gccuggcuaauuuuuuaa

SEQ ID NO: 40656 - RNA, 16 nt, Homo sapiens
gccugggccgggcugg

SEQ ID NO: 40657 - RNA, 23 nt, Homo sapiens
caggaucuccaggugcguagcug

SEQ ID NO: 40658 - RNA, 19 nt, Homo sapiens
ucuccaggugcguagcugg

SEQ ID NO: 40659 - RNA, 24 nt, Homo sapiens
uggcaugaggcugccaguggcuug

SEQ ID NO: 40660 - RNA, 22 nt, Homo sapiens
gaacuccuaaccucagggugau

SEQ ID NO: 40661 - RNA, 18 nt, Homo sapiens
aacccugcuuugguugga

SEQ ID NO: 40662 - RNA, 20 nt, Homo sapiens
acagggacuuuguugaggga

SEQ ID NO: 40663 - RNA, 16 nt, Homo sapiens
ccccccaucccucccc

SEQ ID NO: 40664 - RNA, 21 nt, Homo sapiens
gagaggagagaggagcccuau

SEQ ID NO: 40665 - RNA, 15 nt, Homo sapiens
gagggccagaucuuc

SEQ ID NO: 40666 - RNA, 19 nt, Homo sapiens
gauggggguggaggcuggg

SEQ ID NO: 40667 - RNA, 20 nt, Homo sapiens
gcuccuguuuccccuccccc

SEQ ID NO: 40668 - RNA, 17 nt, Homo sapiens
ggaaaggugacuggaca

SEQ ID NO: 40669 - RNA, 22 nt, Homo sapiens
ggggaggcaguggggcaaaggc

SEQ ID NO: 40670 - RNA, 19 nt, Homo sapiens
guggaggcuggggauggga

SEQ ID NO: 40671 - RNA, 19 nt, Homo sapiens
uaaauacucuucugcaccc

SEQ ID NO: 40672 - RNA, 15 nt, Homo sapiens
cccguggaggugggg

SEQ ID NO: 40673 - RNA, 16 nt, Homo sapiens
ccgaggaagcccagag

SEQ ID NO: 40674 - RNA, 18 nt, Homo sapiens
gagagcccguggaggugg

SEQ ID NO: 40675 - RNA, 23 nt, Homo sapiens
gggacaggaaaaaggagagaauc

SEQ ID NO: 40676 - RNA, 17 nt, Homo sapiens
ucgugggcccagaagaa

SEQ ID NO: 40677 - RNA, 22 nt, Homo sapiens
uggguuuucccagagaggugcc

SEQ ID NO: 40678 - RNA, 19 nt, Homo sapiens
uguccuguuuggguggcca

SEQ ID NO: 40679 - RNA, 19 nt, Homo sapiens
aaaaauaggcgacccuugg

SEQ ID NO: 40680 - RNA, 19 nt, Homo sapiens
aaguauuccuccaauauca

SEQ ID NO: 40681 - RNA, 22 nt, Homo sapiens
agccacuuaccaggcauaaaaa

SEQ ID NO: 40682 - RNA, 24 nt, Homo sapiens
gcgcgggagcagagggcaugcugc

SEQ ID NO: 40683 - RNA, 23 nt, Homo sapiens
ucugggcuauuuagagucauuuu

SEQ ID NO: 40684 - RNA, 15 nt, Homo sapiens
ucuggggagagcugg

SEQ ID NO: 40685 - RNA, 24 nt, Homo sapiens
ugaaaggagagggguagacugagg

SEQ ID NO: 40686 - RNA, 19 nt, Homo sapiens
uuccugggauaaaaauaaa

SEQ ID NO: 40687 - RNA, 22 nt, Homo sapiens
aucuugcugaacuuuccaucaa

SEQ ID NO: 40688 - RNA, 19 nt, Homo sapiens
uacaaagcaggguguagca

SEQ ID NO: 40689 - RNA, 17 nt, Homo sapiens
uuucuugguuuuguugc

SEQ ID NO: 40690 - RNA, 23 nt, Homo sapiens
uuuuucuugguuuuguugcugau

SEQ ID NO: 40691 - RNA, 19 nt, Homo sapiens
aagcaggaagacuuuugca

SEQ ID NO: 40692 - RNA, 20 nt, Homo sapiens
acauaacauuuauacauuuu

SEQ ID NO: 40693 - RNA, 16 nt, Homo sapiens
accgcucggcggcgcc

SEQ ID NO: 40694 - RNA, 20 nt, Homo sapiens
agguaacaucugcgagaacu

SEQ ID NO: 40695 - RNA, 21 nt, Homo sapiens
auuuuguuaaaacaaaacaaa

SEQ ID NO: 40696 - RNA, 22 nt, Homo sapiens
ccgggaagccggggugcgcccg

SEQ ID NO: 40697 - RNA, 14 nt, Homo sapiens
ccgggggacgcgcc

SEQ ID NO: 40698 - RNA, 20 nt, Homo sapiens
ccucgggcucucgggcggcg

SEQ ID NO: 40699 - RNA, 17 nt, Homo sapiens
cgagaacugccacacac

SEQ ID NO: 40700 - RNA, 20 nt, Homo sapiens
cggcgcccagggguuggggc

SEQ ID NO: 40701 - RNA, 19 nt, Homo sapiens
cgggcgcucgggguccgcg

SEQ ID NO: 40702 - RNA, 19 nt, Homo sapiens
cgucgcgcuccgggaagcc

SEQ ID NO: 40703 - RNA, 18 nt, Homo sapiens
cucggcggcgccgcgccc

SEQ ID NO: 40704 - RNA, 15 nt, Homo sapiens
gaggaugcccggcgc

SEQ ID NO: 40705 - RNA, 16 nt, Homo sapiens
gccccccuccccggcu

SEQ ID NO: 40706 - RNA, 25 nt, Homo sapiens
gcgcuccgggaagccggggugcgcc

SEQ ID NO: 40707 - RNA, 20 nt, Homo sapiens
ggauagagggcgaguuaaau

SEQ ID NO: 40708 - RNA, 17 nt, Homo sapiens
ggcgcgggcgguggccg

SEQ ID NO: 40709 - RNA, 26 nt, Homo sapiens
ggcggagggggcgcgggcgggggcgg

SEQ ID NO: 40710 - RNA, 19 nt, Homo sapiens
ggcugcugcugcugcuggu

SEQ ID NO: 40711 - RNA, 19 nt, Homo sapiens
gggcgaggggcggaggggg

SEQ ID NO: 40712 - RNA, 20 nt, Homo sapiens
guccggggaggcccgcgggg

SEQ ID NO: 40713 - RNA, 18 nt, Homo sapiens
uaagcugcaguaugaaca

SEQ ID NO: 40714 - RNA, 18 nt, Homo sapiens
uccaugaucaauacagac

SEQ ID NO: 40715 - RNA, 18 nt, Homo sapiens
ucgagggagcagaaaacg

SEQ ID NO: 40716 - RNA, 23 nt, Homo sapiens
ucgggguccgcgccgccgccggg

SEQ ID NO: 40717 - RNA, 22 nt, Homo sapiens
ugcgagaacugccacacacugg

SEQ ID NO: 40718 - RNA, 16 nt, Homo sapiens
uuaugcaauaacagaa

SEQ ID NO: 40719 - RNA, 19 nt, Homo sapiens
agggcgugugaacaaggga

SEQ ID NO: 40720 - RNA, 19 nt, Homo sapiens
aguucauagaaaaguuacu

SEQ ID NO: 40721 - RNA, 17 nt, Homo sapiens
ccccaagggagaaugca

SEQ ID NO: 40722 - RNA, 22 nt, Homo sapiens
gggccgcgcccgcuccccggcc

SEQ ID NO: 40723 - RNA, 16 nt, Homo sapiens
gguacgcucgagagag

SEQ ID NO: 40724 - RNA, 20 nt, Homo sapiens
gugcacugugucauauauug

SEQ ID NO: 40725 - RNA, 21 nt, Homo sapiens
ugugucauauauuguacaaca

SEQ ID NO: 40726 - RNA, 18 nt, Homo sapiens
uuacuaagaauauaccag

SEQ ID NO: 40727 - RNA, 19 nt, Homo sapiens
gaaagguugugcaugaaaa

SEQ ID NO: 40728 - RNA, 18 nt, Homo sapiens
ggguagagaggacaaagg

SEQ ID NO: 40729 - RNA, 20 nt, Homo sapiens
ggguugggguccuuguaacu

SEQ ID NO: 40730 - RNA, 21 nt, Homo sapiens
gguaaggagggggaaaaagca

SEQ ID NO: 40731 - RNA, 18 nt, Homo sapiens
uaagaguauugccacaga

SEQ ID NO: 40732 - RNA, 17 nt, Homo sapiens
ucuugagggcaauuccu

SEQ ID NO: 40733 - RNA, 19 nt, Homo sapiens
acugaggagcuugauaaau

SEQ ID NO: 40734 - RNA, 24 nt, Homo sapiens
ccuuuccuuccauauuucuuccgg

SEQ ID NO: 40735 - RNA, 18 nt, Homo sapiens
gcuccuggcaauuggcua

SEQ ID NO: 40736 - RNA, 21 nt, Homo sapiens
ucaaugcuuuuaaagggugga

SEQ ID NO: 40737 - RNA, 21 nt, Homo sapiens
agagauaguugugauuaauuu

SEQ ID NO: 40738 - RNA, 18 nt, Homo sapiens
cauuaaaaagccaacagg

SEQ ID NO: 40739 - RNA, 19 nt, Homo sapiens
ccaugucaaacacuucucu

SEQ ID NO: 40740 - RNA, 17 nt, Homo sapiens
cguggguuccaaggcaa

SEQ ID NO: 40741 - RNA, 17 nt, Homo sapiens
guuccaaggcaacagug

SEQ ID NO: 40742 - RNA, 21 nt, Homo sapiens
ucucuguuuuuggcuugucug

SEQ ID NO: 40743 - RNA, 22 nt, Homo sapiens
uggaaacucacuucuaccuucc

SEQ ID NO: 40744 - RNA, 18 nt, Homo sapiens
uggcuugucugggugcug

SEQ ID NO: 40745 - RNA, 18 nt, Homo sapiens
agcagcuucuggcgggcu

SEQ ID NO: 40746 - RNA, 22 nt, Homo sapiens
agcagcuucuggcgggcucggg

SEQ ID NO: 40747 - RNA, 24 nt, Homo sapiens
cagccgccucucgaccgccgcgcg

SEQ ID NO: 40748 - RNA, 16 nt, Homo sapiens
cgaccgccgcgcgggg

SEQ ID NO: 40749 - RNA, 23 nt, Homo sapiens
cuccgcgccacagcucccgccgg

SEQ ID NO: 40750 - RNA, 20 nt, Homo sapiens
agcacuagggauacaagagg

SEQ ID NO: 40751 - RNA, 19 nt, Homo sapiens
ccugggggguggggguggg

SEQ ID NO: 40752 - RNA, 28 nt, Homo sapiens
ggacacuacaacauugucauggggaaau

SEQ ID NO: 40753 - RNA, 19 nt, Homo sapiens
cauauugccaguuuauuuc

SEQ ID NO: 40754 - RNA, 22 nt, Homo sapiens
ccgcgcgccuacgccccccgcc

SEQ ID NO: 40755 - RNA, 19 nt, Homo sapiens
gcgcggggcggggcggggc

SEQ ID NO: 40756 - RNA, 21 nt, Homo sapiens
ggcggggcggggcggggcgcc

SEQ ID NO: 40757 - RNA, 22 nt, Homo sapiens
uaauaucucuauaucauaguga

SEQ ID NO: 40758 - RNA, 24 nt, Homo sapiens
aagggaaggggcuaaagcaggaag

SEQ ID NO: 40759 - RNA, 17 nt, Homo sapiens
agcggguggggcguguc

SEQ ID NO: 40760 - RNA, 19 nt, Homo sapiens
agcugcagaguccgcagag

SEQ ID NO: 40761 - RNA, 18 nt, Homo sapiens
cagcgcgccgccagcucc

SEQ ID NO: 40762 - RNA, 20 nt, Homo sapiens
cagcgcgccgccagcuccuc

SEQ ID NO: 40763 - RNA, 19 nt, Homo sapiens
caggcgcgggcagugcgcg

SEQ ID NO: 40764 - RNA, 24 nt, Homo sapiens
ccggcucugcgcucgggcccggcc

SEQ ID NO: 40765 - RNA, 19 nt, Homo sapiens
cgcucgggcccggccgcug

SEQ ID NO: 40766 - RNA, 15 nt, Homo sapiens
ggaggggugggguac

SEQ ID NO: 40767 - RNA, 18 nt, Homo sapiens
gggguggagugggguggg

SEQ ID NO: 40768 - RNA, 18 nt, Homo sapiens
ggggugggguggaguggg

SEQ ID NO: 40769 - RNA, 19 nt, Homo sapiens
ggugcagucucggcccggc

SEQ ID NO: 40770 - RNA, 17 nt, Homo sapiens
gguggggugagaugagu

SEQ ID NO: 40771 - RNA, 17 nt, Homo sapiens
ggugggguggggugaga

SEQ ID NO: 40772 - RNA, 18 nt, Homo sapiens
ucgggcccggccgcugcg

SEQ ID NO: 40773 - RNA, 19 nt, Homo sapiens
uggaguggggugggguggg

SEQ ID NO: 40774 - RNA, 18 nt, Homo sapiens
uggggugggguggagugg

SEQ ID NO: 40775 - RNA, 20 nt, Homo sapiens
gcgccccgaguuccggcagc

SEQ ID NO: 40776 - RNA, 23 nt, Homo sapiens
ggaugcgcgccccgaguuccggc

SEQ ID NO: 40777 - RNA, 18 nt, Homo sapiens
ucuccgaucugcgggauc

SEQ ID NO: 40778 - RNA, 24 nt, Homo sapiens
ugagggacagggacacccuuugcg

SEQ ID NO: 40779 - RNA, 22 nt, Homo sapiens
ugggauccgggcuuucucacug

SEQ ID NO: 40780 - RNA, 21 nt, Homo sapiens
uauugcaggugggugcaccug

SEQ ID NO: 40781 - RNA, 19 nt, Homo sapiens
accccgucaaagauuugca

SEQ ID NO: 40782 - RNA, 15 nt, Homo sapiens
auuuugcugcucucc

SEQ ID NO: 40783 - RNA, 18 nt, Homo sapiens
caccacaccccaaccccc

SEQ ID NO: 40784 - RNA, 23 nt, Homo sapiens
uccugcugggggggggggggggc

SEQ ID NO: 40785 - RNA, 20 nt, Homo sapiens
ugcugggggggggggggggc

SEQ ID NO: 40786 - RNA, 18 nt, Homo sapiens
aaagaggagcaggagaau

SEQ ID NO: 40787 - RNA, 21 nt, Homo sapiens
aaggacacugacuaagggaaa

SEQ ID NO: 40788 - RNA, 19 nt, Homo sapiens
aaggaccagggcuuuggag

SEQ ID NO: 40789 - RNA, 15 nt, Homo sapiens
agaucuuccccugcc

SEQ ID NO: 40790 - RNA, 20 nt, Homo sapiens
agcucagaccugugccugcu

SEQ ID NO: 40791 - RNA, 18 nt, Homo sapiens
aggaaaaagaaagaaaac

SEQ ID NO: 40792 - RNA, 18 nt, Homo sapiens
agggagggaacagaggaa

SEQ ID NO: 40793 - RNA, 20 nt, Homo sapiens
aguauacgcagagccacacc

SEQ ID NO: 40794 - RNA, 22 nt, Homo sapiens
ccagcuuuggcugacgcugcag

SEQ ID NO: 40795 - RNA, 18 nt, Homo sapiens
gacucagggugucacagg

SEQ ID NO: 40796 - RNA, 14 nt, Homo sapiens
gaggcaagggcucu

SEQ ID NO: 40797 - RNA, 21 nt, Homo sapiens
gccuggcccuguggggagcag

SEQ ID NO: 40798 - RNA, 18 nt, Homo sapiens
ggcaggggagguaggagg

SEQ ID NO: 40799 - RNA, 17 nt, Homo sapiens
ggggagggguggcaggg

SEQ ID NO: 40800 - RNA, 19 nt, Homo sapiens
ggggagggguggcaggggg

SEQ ID NO: 40801 - RNA, 17 nt, Homo sapiens
uaaauggcgccucugga

SEQ ID NO: 40802 - RNA, 19 nt, Homo sapiens
uggcaccaccacccgggcc

SEQ ID NO: 40803 - RNA, 18 nt, Homo sapiens
aaggggaggaagugggaa

SEQ ID NO: 40804 - RNA, 16 nt, Homo sapiens
acuuggggccggggcu

SEQ ID NO: 40805 - RNA, 18 nt, Homo sapiens
aggcacuuaguggggagg

SEQ ID NO: 40806 - RNA, 20 nt, Homo sapiens
agggguugugggcaaugggu

SEQ ID NO: 40807 - RNA, 20 nt, Homo sapiens
ggggaggaagugggaagagc

SEQ ID NO: 40808 - RNA, 16 nt, Homo sapiens
uacagaaaggugcagg

SEQ ID NO: 40809 - RNA, 22 nt, Homo sapiens
uugaauuaguauuuguacagaa

SEQ ID NO: 40810 - RNA, 22 nt, Homo sapiens
agcugcaggaucggguccggag

SEQ ID NO: 40811 - RNA, 17 nt, Homo sapiens
ccugggggccaccacgg

SEQ ID NO: 40812 - RNA, 19 nt, Homo sapiens
ggcccccuucaguuugggc

SEQ ID NO: 40813 - RNA, 20 nt, Homo sapiens
ugagcaguucugguccucag

SEQ ID NO: 40814 - RNA, 24 nt, Homo sapiens
ucauaaagcaagugaccaaaaaua

SEQ ID NO: 40815 - RNA, 22 nt, Homo sapiens
aaacugauuuaaacagauuacu

SEQ ID NO: 40816 - RNA, 15 nt, Homo sapiens
agcucuaaguguccu

SEQ ID NO: 40817 - RNA, 18 nt, Homo sapiens
ccagaagaauuaaaaaca

SEQ ID NO: 40818 - RNA, 18 nt, Homo sapiens
gauuuaaacagauuacuu

SEQ ID NO: 40819 - RNA, 16 nt, Homo sapiens
ggggagacagggaggg

SEQ ID NO: 40820 - RNA, 20 nt, Homo sapiens
caagugaguccgcuccucag

SEQ ID NO: 40821 - RNA, 15 nt, Homo sapiens
cgcguccucccuccc

SEQ ID NO: 40822 - RNA, 18 nt, Homo sapiens
cuccucuucuuacuucua

SEQ ID NO: 40823 - RNA, 17 nt, Homo sapiens
ggagagcaggucuccug

SEQ ID NO: 40824 - RNA, 15 nt, Homo sapiens
ggcucccccacccga

SEQ ID NO: 40825 - RNA, 15 nt, Homo sapiens
acaucuguaagaaaa

SEQ ID NO: 40826 - RNA, 18 nt, Homo sapiens
cccuucugauacacacag

SEQ ID NO: 40827 - RNA, 20 nt, Homo sapiens
ccgccgcgcgcgccccuccg

SEQ ID NO: 40828 - RNA, 16 nt, Homo sapiens
ggugccgccgccgcgc

SEQ ID NO: 40829 - RNA, 24 nt, Homo sapiens
ucagucuaaaaaauaucacaggua

SEQ ID NO: 40830 - RNA, 16 nt, Homo sapiens
agaucacuuucuucac

SEQ ID NO: 40831 - RNA, 16 nt, Homo sapiens
aggcaggcgggggacu

SEQ ID NO: 40832 - RNA, 18 nt, Homo sapiens
agggacggggggaggggg

SEQ ID NO: 40833 - RNA, 21 nt, Homo sapiens
cgccgcgggcgcgggguacgg

SEQ ID NO: 40834 - RNA, 19 nt, Homo sapiens
cgcgggguuccggggcccc

SEQ ID NO: 40835 - RNA, 19 nt, Homo sapiens
gcgccggugccggguagcc

SEQ ID NO: 40836 - RNA, 15 nt, Homo sapiens
ggggagggggagggg

SEQ ID NO: 40837 - RNA, 17 nt, Homo sapiens
ggggagggggaggggcg

SEQ ID NO: 40838 - RNA, 18 nt, Homo sapiens
gggggcaccaagaccgca

SEQ ID NO: 40839 - RNA, 16 nt, Homo sapiens
ucaauuccauucucug

SEQ ID NO: 40840 - RNA, 22 nt, Homo sapiens
caucauccugggugucagcagc

SEQ ID NO: 40841 - RNA, 21 nt, Homo sapiens
aaaacuaaacuuaaaauuugu

SEQ ID NO: 40842 - RNA, 18 nt, Homo sapiens
aagagguggaggggggag

SEQ ID NO: 40843 - RNA, 14 nt, Homo sapiens
agcagggaggacgg

SEQ ID NO: 40844 - RNA, 19 nt, Homo sapiens
agcggaaaagaggaaaugg

SEQ ID NO: 40845 - RNA, 18 nt, Homo sapiens
agcggacggaaugaaugg

SEQ ID NO: 40846 - RNA, 19 nt, Homo sapiens
caccaaauaacucaucacg

SEQ ID NO: 40847 - RNA, 14 nt, Homo sapiens
ccacuaagagcgcg

SEQ ID NO: 40848 - RNA, 21 nt, Homo sapiens
cugcgcucucaggccggacuc

SEQ ID NO: 40849 - RNA, 22 nt, Homo sapiens
gacugggggcuaggggcccggg

SEQ ID NO: 40850 - RNA, 19 nt, Homo sapiens
gcugucaauuauugacagu

SEQ ID NO: 40851 - RNA, 17 nt, Homo sapiens
ggaggcgcggaggccga

SEQ ID NO: 40852 - RNA, 17 nt, Homo sapiens
guggaggggggagaggg

SEQ ID NO: 40853 - RNA, 19 nt, Homo sapiens
uauagauuuuaguauaaaa

SEQ ID NO: 40854 - RNA, 17 nt, Homo sapiens
ucgggggaggggaggcg

SEQ ID NO: 40855 - RNA, 21 nt, Homo sapiens
ugggaggccagagagucgggg

SEQ ID NO: 40856 - RNA, 18 nt, Homo sapiens
uuucuugguaauacucau

SEQ ID NO: 40857 - RNA, 21 nt, Homo sapiens
ccuccggccgcgcuccuuccg

SEQ ID NO: 40858 - RNA, 16 nt, Homo sapiens
cucgaacccggacccc

SEQ ID NO: 40859 - RNA, 24 nt, Homo sapiens
gaucaugguuaggcucacggccaa

SEQ ID NO: 40860 - RNA, 14 nt, Homo sapiens
guggagaugguggg

SEQ ID NO: 40861 - RNA, 18 nt, Homo sapiens
gcggggagaggggagcgg

SEQ ID NO: 40862 - RNA, 19 nt, Homo sapiens
acgugcccguuagcggagg

SEQ ID NO: 40863 - RNA, 19 nt, Homo sapiens
cccguuagcggagggggcg

SEQ ID NO: 40864 - RNA, 20 nt, Homo sapiens
cccuggcuggggccugggac

SEQ ID NO: 40865 - RNA, 19 nt, Homo sapiens
cggcccccuggcuggggcc

SEQ ID NO: 40866 - RNA, 20 nt, Homo sapiens
gcccccuggcuggggccugg

SEQ ID NO: 40867 - RNA, 15 nt, Homo sapiens
gcuuuauuguuugug

SEQ ID NO: 40868 - RNA, 22 nt, Homo sapiens
gggcagucgauuuccgguugcc

SEQ ID NO: 40869 - RNA, 18 nt, Homo sapiens
aggagcuggggggggggg

SEQ ID NO: 40870 - RNA, 21 nt, Homo sapiens
ccgagucuccugcagcgggag

SEQ ID NO: 40871 - RNA, 18 nt, Homo sapiens
ccugcagcgggagggggc

SEQ ID NO: 40872 - RNA, 17 nt, Homo sapiens
ggaccccgguugucgca

SEQ ID NO: 40873 - RNA, 18 nt, Homo sapiens
ggggccaggggcaacgcu

SEQ ID NO: 40874 - RNA, 16 nt, Homo sapiens
guccggcgccggcagc

SEQ ID NO: 40875 - RNA, 22 nt, Homo sapiens
aaaacaucuguucaaauucaau

SEQ ID NO: 40876 - RNA, 19 nt, Homo sapiens
cuucucuucagugaguauu

SEQ ID NO: 40877 - RNA, 18 nt, Homo sapiens
ggacauugcuuauauuca

SEQ ID NO: 40878 - RNA, 14 nt, Homo sapiens
uccagcaucuccug

SEQ ID NO: 40879 - RNA, 17 nt, Homo sapiens
ugucccagcuuccuccc

SEQ ID NO: 40880 - RNA, 24 nt, Homo sapiens
aggcaugguggcucacauuugugg

SEQ ID NO: 40881 - RNA, 20 nt, Homo sapiens
cugcgcgcggcgacuggacg

SEQ ID NO: 40882 - RNA, 15 nt, Homo sapiens
cuggcacagggugga

SEQ ID NO: 40883 - RNA, 15 nt, Homo sapiens
gacaacggcgcgggg

SEQ ID NO: 40884 - RNA, 19 nt, Homo sapiens
gagggauggaauuaugaca

SEQ ID NO: 40885 - RNA, 16 nt, Homo sapiens
gaguucaagaucagcc

SEQ ID NO: 40886 - RNA, 21 nt, Homo sapiens
ggagaucgcuguuuaucuaga

SEQ ID NO: 40887 - RNA, 19 nt, Homo sapiens
ggaggccaaggcaggagga

SEQ ID NO: 40888 - RNA, 19 nt, Homo sapiens
ggagggaagucuggaggau

SEQ ID NO: 40889 - RNA, 19 nt, Homo sapiens
ggcuguggggccacaggga

SEQ ID NO: 40890 - RNA, 18 nt, Homo sapiens
ggucuguggacggcagga

SEQ ID NO: 40891 - RNA, 14 nt, Homo sapiens
gugggugggagugc

SEQ ID NO: 40892 - RNA, 20 nt, Homo sapiens
ugaccaggggcuuugcaaac

SEQ ID NO: 40893 - RNA, 16 nt, Homo sapiens
ugcagggcaauuagga

SEQ ID NO: 40894 - RNA, 17 nt, Homo sapiens
uggcucacauuuguggu

SEQ ID NO: 40895 - RNA, 18 nt, Homo sapiens
ugggggcaggggagggac

SEQ ID NO: 40896 - RNA, 17 nt, Homo sapiens
caccggcgucacgugaa

SEQ ID NO: 40897 - RNA, 19 nt, Homo sapiens
cgcugggauuucuggcugg

SEQ ID NO: 40898 - RNA, 18 nt, Homo sapiens
aggagguggggaggccag

SEQ ID NO: 40899 - RNA, 19 nt, Homo sapiens
agggcggggcgguggcggg

SEQ ID NO: 40900 - RNA, 21 nt, Homo sapiens
ccggcucggcgguggcaaggc

SEQ ID NO: 40901 - RNA, 18 nt, Homo sapiens
gcguuccuucuccugucc

SEQ ID NO: 40902 - RNA, 19 nt, Homo sapiens
ggacgggaggaggugggga

SEQ ID NO: 40903 - RNA, 21 nt, Homo sapiens
ggagggcggggcgguggcggg

SEQ ID NO: 40904 - RNA, 24 nt, Homo sapiens
ggcaacccccagcccagccggccc

SEQ ID NO: 40905 - RNA, 20 nt, Homo sapiens
ggccagcagcgggccguccg

SEQ ID NO: 40906 - RNA, 21 nt, Homo sapiens
gggcaggaguacccugggggg

SEQ ID NO: 40907 - RNA, 24 nt, Homo sapiens
gggcaggaguacccuggggggcgg

SEQ ID NO: 40908 - RNA, 18 nt, Homo sapiens
ucaaaggagggaaacuga

SEQ ID NO: 40909 - RNA, 16 nt, Homo sapiens
ugccccagguggggcc

SEQ ID NO: 40910 - RNA, 17 nt, Homo sapiens
uggcaaggcuugagugc

SEQ ID NO: 40911 - RNA, 20 nt, Homo sapiens
acgucccaccagcgggcgcc

SEQ ID NO: 40912 - RNA, 19 nt, Homo sapiens
aggccagugcccugggcca

SEQ ID NO: 40913 - RNA, 18 nt, Homo sapiens
cagccacagcggcaguga

SEQ ID NO: 40914 - RNA, 18 nt, Homo sapiens
cagcccgagccuuacgag

SEQ ID NO: 40915 - RNA, 18 nt, Homo sapiens
cccacagggcugugugga

SEQ ID NO: 40916 - RNA, 21 nt, Homo sapiens
ccccggcucagcugagcuggg

SEQ ID NO: 40917 - RNA, 22 nt, Homo sapiens
ccgccgcucgcaccccuucucc

SEQ ID NO: 40918 - RNA, 20 nt, Homo sapiens
cuuucacaggcacguuuauu

SEQ ID NO: 40919 - RNA, 20 nt, Homo sapiens
gaccucgucacguccaccug

SEQ ID NO: 40920 - RNA, 19 nt, Homo sapiens
gagcugggguggggcuggg

SEQ ID NO: 40921 - RNA, 18 nt, Homo sapiens
gcgaaugccugaaugcag

SEQ ID NO: 40922 - RNA, 18 nt, Homo sapiens
ggaggggacagagagagc

SEQ ID NO: 40923 - RNA, 19 nt, Homo sapiens
gggcuguguggauggagga

SEQ ID NO: 40924 - RNA, 19 nt, Homo sapiens
uacgagagcggcaguuggc

SEQ ID NO: 40925 - RNA, 24 nt, Homo sapiens
uccccaucucuccugucugucccu

SEQ ID NO: 40926 - RNA, 21 nt, Homo sapiens
ucuccugucugucccuccccu

SEQ ID NO: 40927 - RNA, 19 nt, Homo sapiens
ugcccugggccaccucagc

SEQ ID NO: 40928 - RNA, 16 nt, Homo sapiens
uucaccacaggcugug

SEQ ID NO: 40929 - RNA, 24 nt, Homo sapiens
aguggaggggaaggacugcgggga

SEQ ID NO: 40930 - RNA, 22 nt, Homo sapiens
cacucgguuugugguacauugc

SEQ ID NO: 40931 - RNA, 29 nt, Homo sapiens
ggggaggaacggguggcuggggaggagcg

SEQ ID NO: 40932 - RNA, 16 nt, Homo sapiens
gguuuuccuuaaaaua

SEQ ID NO: 40933 - RNA, 18 nt, Homo sapiens
uauguuauuauaguuucu

SEQ ID NO: 40934 - RNA, 19 nt, Homo sapiens
ucuguguuuaugucacucg

SEQ ID NO: 40935 - RNA, 17 nt, Homo sapiens
uggcagcccuaguaacc

SEQ ID NO: 40936 - RNA, 17 nt, Homo sapiens
ugggcuauauaauauug

SEQ ID NO: 40937 - RNA, 19 nt, Homo sapiens
uuggacagaaguccugugg

SEQ ID NO: 40938 - RNA, 18 nt, Homo sapiens
caccaccugggcaccccc

SEQ ID NO: 40939 - RNA, 19 nt, Homo sapiens
ccugggcacccccuggccc

SEQ ID NO: 40940 - RNA, 20 nt, Homo sapiens
cucgcgggcagcccggaucc

SEQ ID NO: 40941 - RNA, 23 nt, Homo sapiens
gggcacccccuggcccugcccug

SEQ ID NO: 40942 - RNA, 19 nt, Homo sapiens
ugaggaaacuguggcugaa

SEQ ID NO: 40943 - RNA, 25 nt, Homo sapiens
cgccagcaaguuuguguucccagug

SEQ ID NO: 40944 - RNA, 20 nt, Homo sapiens
ggcucuucccgccagcaagu

SEQ ID NO: 40945 - RNA, 18 nt, Homo sapiens
uaaagguaaggaacaaug

SEQ ID NO: 40946 - RNA, 16 nt, Homo sapiens
uggaugggaaagggaa

SEQ ID NO: 40947 - RNA, 17 nt, Homo sapiens
aaggaggaggagaagaa

SEQ ID NO: 40948 - RNA, 23 nt, Homo sapiens
acauauuauauauauauauauau

SEQ ID NO: 40949 - RNA, 23 nt, Homo sapiens
auacauauuauauauauauauau

SEQ ID NO: 40950 - RNA, 23 nt, Homo sapiens
auauacauauuauauauauauau

SEQ ID NO: 40951 - RNA, 23 nt, Homo sapiens
auauauacauauuauauauauau

SEQ ID NO: 40952 - RNA, 23 nt, Homo sapiens
auauauauauauauaaaauauau

SEQ ID NO: 40953 - RNA, 19 nt, Homo sapiens
auauauauauauauacaua

SEQ ID NO: 40954 - RNA, 22 nt, Homo sapiens
auauauauauauauauauauau

SEQ ID NO: 40955 - RNA, 22 nt, Homo sapiens
caauauauauauauauacauau

SEQ ID NO: 40956 - RNA, 18 nt, Homo sapiens
caguguucuucuggcugu

SEQ ID NO: 40957 - RNA, 19 nt, Homo sapiens
cccagccuccggcuccguc

SEQ ID NO: 40958 - RNA, 21 nt, Homo sapiens
ccugccgccccguccuggccc

SEQ ID NO: 40959 - RNA, 19 nt, Homo sapiens
cgcgcgcggguggcgggcg

SEQ ID NO: 40960 - RNA, 17 nt, Homo sapiens
cggguggcgggcgggcg

SEQ ID NO: 40961 - RNA, 22 nt, Homo sapiens
cuguaagaugcagcagagaaua

SEQ ID NO: 40962 - RNA, 19 nt, Homo sapiens
cuguguuucucccaaaugu

SEQ ID NO: 40963 - RNA, 15 nt, Homo sapiens
gcggcgcucacggcg

SEQ ID NO: 40964 - RNA, 18 nt, Homo sapiens
gcgggcgggcguggggcc

SEQ ID NO: 40965 - RNA, 20 nt, Homo sapiens
gcgggcgggcguggggccgg

SEQ ID NO: 40966 - RNA, 18 nt, Homo sapiens
gcuaguucaguaguuucc

SEQ ID NO: 40967 - RNA, 18 nt, Homo sapiens
gggcgggcguggggccgg

SEQ ID NO: 40968 - RNA, 21 nt, Homo sapiens
guccagaaauggaauacuguc

SEQ ID NO: 40969 - RNA, 25 nt, Homo sapiens
uacauauuauauauauauauauaua

SEQ ID NO: 40970 - RNA, 26 nt, Homo sapiens
uacauauuauauauauauauauauau

SEQ ID NO: 40971 - RNA, 26 nt, Homo sapiens
uauacauauuauauauauauauauau

SEQ ID NO: 40972 - RNA, 26 nt, Homo sapiens
uauauacauauuauauauauauauau

SEQ ID NO: 40973 - RNA, 26 nt, Homo sapiens
uauauauacauauuauauauauauau

SEQ ID NO: 40974 - RNA, 26 nt, Homo sapiens
uauauauauacauauuauauauauau

SEQ ID NO: 40975 - RNA, 18 nt, Homo sapiens
uauauauauauauacaua

SEQ ID NO: 40976 - RNA, 25 nt, Homo sapiens
uauauauauauauauaaaauauaua

SEQ ID NO: 40977 - RNA, 18 nt, Homo sapiens
uauauauauauauauaua

SEQ ID NO: 40978 - RNA, 25 nt, Homo sapiens
uauauauauauauauauaaaauaua

SEQ ID NO: 40979 - RNA, 19 nt, Homo sapiens
uauauauauauauauauau

SEQ ID NO: 40980 - RNA, 20 nt, Homo sapiens
uauauauauauauauauaua

SEQ ID NO: 40981 - RNA, 22 nt, Homo sapiens
uauauauauauauauauauaua

SEQ ID NO: 40982 - RNA, 23 nt, Homo sapiens
uauauauauauauauauauauau

SEQ ID NO: 40983 - RNA, 24 nt, Human papillomavirus type 25
uauauauauauauauauauauaua

SEQ ID NO: 40984 - RNA, 25 nt, Homo sapiens
uauauauauauauauauauauauau

SEQ ID NO: 40985 - RNA, 19 nt, Homo sapiens
uauauugaaaaggaucagg

SEQ ID NO: 40986 - RNA, 17 nt, Homo sapiens
uauuucaacaucaccag

SEQ ID NO: 40987 - RNA, 19 nt, Homo sapiens
ucauaagucaugguucuca

SEQ ID NO: 40988 - RNA, 17 nt, Homo sapiens
ucuauacauuuguccag

SEQ ID NO: 40989 - RNA, 20 nt, Homo sapiens
uggcuguguuucucccaaau

SEQ ID NO: 40990 - RNA, 23 nt, Homo sapiens
uguaugcccuuucucacuguucu

SEQ ID NO: 40991 - RNA, 19 nt, Homo sapiens
uucaucuuuuguuccccau

SEQ ID NO: 40992 - RNA, 16 nt, Homo sapiens
aggagggggggaaaac

SEQ ID NO: 40993 - RNA, 28 nt, Homo sapiens
cgcgagcggcgcggggaggcggcgcggc

SEQ ID NO: 40994 - RNA, 21 nt, Homo sapiens
cgcggggaggcggcgcggggg

SEQ ID NO: 40995 - RNA, 16 nt, Homo sapiens
gccccgccgcucuccc

SEQ ID NO: 40996 - RNA, 22 nt, Homo sapiens
gcgagcggcgcggggaggcggc

SEQ ID NO: 40997 - RNA, 17 nt, Homo sapiens
gcgcggggaggcggcgc

SEQ ID NO: 40998 - RNA, 18 nt, Homo sapiens
ggaggcggcgcgggggaa

SEQ ID NO: 40999 - RNA, 15 nt, Homo sapiens
ggaguggggugggag

SEQ ID NO: 41000 - RNA, 18 nt, Homo sapiens
ggaguggggugggagggg

SEQ ID NO: 41001 - RNA, 17 nt, Homo sapiens
guugcacuugaaguaca

SEQ ID NO: 41002 - RNA, 19 nt, Homo sapiens
uacuuagucuuacuuuuuu

SEQ ID NO: 41003 - RNA, 24 nt, Homo sapiens
ucaucguggugaauguccucgagu

SEQ ID NO: 41004 - RNA, 19 nt, Homo sapiens
ucuuauacacgacaacaua

SEQ ID NO: 41005 - RNA, 17 nt, Homo sapiens
uucccuucaacuuuucc

SEQ ID NO: 41006 - RNA, 23 nt, Homo sapiens
cgcuagaggcgggcgcccagagg

SEQ ID NO: 41007 - RNA, 18 nt, Homo sapiens
gcgcuagaggcgggcgcc

SEQ ID NO: 41008 - RNA, 21 nt, Homo sapiens
ccucccugucacugccacacc

SEQ ID NO: 41009 - RNA, 18 nt, Homo sapiens
gggaggaagggaaguagc

SEQ ID NO: 41010 - RNA, 20 nt, Homo sapiens
agcagaagaauuaggggugg

SEQ ID NO: 41011 - RNA, 17 nt, Homo sapiens
cagaaagggugggucaa

SEQ ID NO: 41012 - RNA, 17 nt, Homo sapiens
cagaagaauuaggggug

SEQ ID NO: 41013 - RNA, 21 nt, Homo sapiens
cuucugcuuggcucacuuuuc

SEQ ID NO: 41014 - RNA, 20 nt, Homo sapiens
gggacacauucacuuugcaa

SEQ ID NO: 41015 - RNA, 18 nt, Homo sapiens
gggcugggaggggcuggg

SEQ ID NO: 41016 - RNA, 14 nt, Homo sapiens
ggguggggaaggga

SEQ ID NO: 41017 - RNA, 22 nt, Homo sapiens
guggggguaagagcgguggggg

SEQ ID NO: 41018 - RNA, 18 nt, Homo sapiens
aagagucccggggcucag

SEQ ID NO: 41019 - RNA, 16 nt, Homo sapiens
caagaaucugcaaaag

SEQ ID NO: 41020 - RNA, 17 nt, Homo sapiens
cagcuggggagccaggg

SEQ ID NO: 41021 - RNA, 17 nt, Homo sapiens
ccuugggguaacaacag

SEQ ID NO: 41022 - RNA, 22 nt, Homo sapiens
cgcagggcguggacgcccgggg

SEQ ID NO: 41023 - RNA, 20 nt, Homo sapiens
cugcaaaaguuggagggagc

SEQ ID NO: 41024 - RNA, 16 nt, Homo sapiens
gcaagaaucugcaaaa

SEQ ID NO: 41025 - RNA, 17 nt, Homo sapiens
gccaggccaggccaggc

SEQ ID NO: 41026 - RNA, 21 nt, Homo sapiens
gcccggaagcgcccgcagacg

SEQ ID NO: 41027 - RNA, 19 nt, Homo sapiens
gccuuauuuccccuagccc

SEQ ID NO: 41028 - RNA, 18 nt, Homo sapiens
ugacauggccaugggaug

SEQ ID NO: 41029 - RNA, 19 nt, Homo sapiens
uggggagccagggcugggg

SEQ ID NO: 41030 - RNA, 19 nt, Homo sapiens
uuagcaaaaugagaagcaa

SEQ ID NO: 41031 - RNA, 21 nt, Homo sapiens
ucgccccguuccaggccuccc

SEQ ID NO: 41032 - RNA, 20 nt, Homo sapiens
ucuaaaacagaaggugagga

SEQ ID NO: 41033 - RNA, 21 nt, Homo sapiens
uuacccaaguguguacugucc

SEQ ID NO: 41034 - RNA, 18 nt, Homo sapiens
aacugguuaagaggagca

SEQ ID NO: 41035 - RNA, 20 nt, Homo sapiens
caguguggaccaugagagug

SEQ ID NO: 41036 - RNA, 22 nt, Homo sapiens
gaggugggugacgggcugcggg

SEQ ID NO: 41037 - RNA, 17 nt, Homo sapiens
uauacaugcaugcauau

SEQ ID NO: 41038 - RNA, 23 nt, Homo sapiens
ugauacacacauguauauaugga

SEQ ID NO: 41039 - RNA, 19 nt, Homo sapiens
ugauguuccauuuugucuu

SEQ ID NO: 41040 - RNA, 20 nt, Homo sapiens
ugauguuccauuuugucuug

SEQ ID NO: 41041 - RNA, 18 nt, Homo sapiens
uguuacaguuguguucau

SEQ ID NO: 41042 - RNA, 19 nt, Homo sapiens
aaagaaagaaaaaaaaaga

SEQ ID NO: 41043 - RNA, 21 nt, Homo sapiens
ccgcuggcagcgcuccgcucc

SEQ ID NO: 41044 - RNA, 18 nt, Homo sapiens
ccgggccggggcuucucc

SEQ ID NO: 41045 - RNA, 19 nt, Homo sapiens
ccgggccggggcuucuccc

SEQ ID NO: 41046 - RNA, 21 nt, Homo sapiens
cgcccccucccuccccucgcc

SEQ ID NO: 41047 - RNA, 15 nt, Homo sapiens
gcaaaauagaauaca

SEQ ID NO: 41048 - RNA, 15 nt, Homo sapiens
gcccccucccucccc

SEQ ID NO: 41049 - RNA, 22 nt, Homo sapiens
aggacuguauacugucuuggaa

SEQ ID NO: 41050 - RNA, 16 nt, Homo sapiens
cagucaaaaccaacac

SEQ ID NO: 41051 - RNA, 17 nt, Homo sapiens
cagucaaaaccaacacg

SEQ ID NO: 41052 - RNA, 21 nt, Homo sapiens
gaaaaaaugguuuuguacaug

SEQ ID NO: 41053 - RNA, 21 nt, Homo sapiens
aacuccuccucuuugcuuuuc

SEQ ID NO: 41054 - RNA, 17 nt, Homo sapiens
aucuggguacaauuaau

SEQ ID NO: 41055 - RNA, 20 nt, Homo sapiens
cauacugcuuucuuagugau

SEQ ID NO: 41056 - RNA, 18 nt, Homo sapiens
ccaagaugugaacuuccc

SEQ ID NO: 41057 - RNA, 17 nt, Homo sapiens
uaacucaagcuggaucu

SEQ ID NO: 41058 - RNA, 14 nt, Homo sapiens
ucgcuaguuccuca

SEQ ID NO: 41059 - RNA, 18 nt, Homo sapiens
ugaugaaauggcugcuuc

SEQ ID NO: 41060 - RNA, 19 nt, Homo sapiens
uggcuuucuguaccuuuuu

SEQ ID NO: 41061 - RNA, 16 nt, Homo sapiens
uugcuagucaacucag

SEQ ID NO: 41062 - RNA, 18 nt, Homo sapiens
uuggcuacaugaggggcc

SEQ ID NO: 41063 - RNA, 16 nt, Homo sapiens
uuucauggaauaaacu

SEQ ID NO: 41064 - RNA, 22 nt, Homo sapiens
uuuuguucagcuuuucucuuca

SEQ ID NO: 41065 - RNA, 19 nt, Homo sapiens
uuuuucuuggucuuuuggc

SEQ ID NO: 41066 - RNA, 19 nt, Homo sapiens
cucaucuuucucaugacuu

SEQ ID NO: 41067 - RNA, 21 nt, Homo sapiens
uccagcuaaaguacguauuaa

SEQ ID NO: 41068 - RNA, 22 nt, Homo sapiens
agggggggaguucuccaugacu

SEQ ID NO: 41069 - RNA, 21 nt, Homo sapiens
caccccacuccccacgugucc

SEQ ID NO: 41070 - RNA, 18 nt, Homo sapiens
cugcaugcucuuuugcuu

SEQ ID NO: 41071 - RNA, 14 nt, Homo sapiens
gcacugcaugcucu

SEQ ID NO: 41072 - RNA, 18 nt, Homo sapiens
gcagaagauuagcaaucg

SEQ ID NO: 41073 - RNA, 22 nt, Homo sapiens
gcauaguauuuaacauucaucu

SEQ ID NO: 41074 - RNA, 18 nt, Homo sapiens
gcgcgggugcgcggcgcc

SEQ ID NO: 41075 - RNA, 20 nt, Homo sapiens
ggguagaaaggaggaauucu

SEQ ID NO: 41076 - RNA, 22 nt, Homo sapiens
guguugcuaacucaaauuuugg

SEQ ID NO: 41077 - RNA, 20 nt, Homo sapiens
uaauuuauggguagaaagga

SEQ ID NO: 41078 - RNA, 23 nt, Homo sapiens
uacauauacauaaauauguacag

SEQ ID NO: 41079 - RNA, 21 nt, Homo sapiens
ucaagagaaaguaaagauaga

SEQ ID NO: 41080 - RNA, 18 nt, Homo sapiens
ugcuggggaaacagggag

SEQ ID NO: 41081 - RNA, 18 nt, Homo sapiens
ugggaaaaagaauaugca

SEQ ID NO: 41082 - RNA, 19 nt, Homo sapiens
uuggauaaaaacuuucagu

SEQ ID NO: 41083 - RNA, 17 nt, Homo sapiens
acugauuggccccgccc

SEQ ID NO: 41084 - RNA, 17 nt, Homo sapiens
ucagaguacauuaguaa

SEQ ID NO: 41085 - RNA, 24 nt, Homo sapiens
ugcuuggguucuacuuguuugggu

SEQ ID NO: 41086 - RNA, 17 nt, Homo sapiens
aagaguaugauacaaca

SEQ ID NO: 41087 - RNA, 22 nt, Homo sapiens
auacauauauauauauauauau

SEQ ID NO: 41088 - RNA, 22 nt, Homo sapiens
auauauauauauauauguauau

SEQ ID NO: 41089 - RNA, 22 nt, Homo sapiens
auauauauauauauguauauau

SEQ ID NO: 41090 - RNA, 22 nt, Homo sapiens
auauauauauauguauauauau

SEQ ID NO: 41091 - RNA, 23 nt, Homo sapiens
cauacauauauauauauauauau

SEQ ID NO: 41092 - RNA, 19 nt, Homo sapiens
cauauauauauauauauau

SEQ ID NO: 41093 - RNA, 19 nt, Homo sapiens
gacagugaaauugacaaug

SEQ ID NO: 41094 - RNA, 24 nt, Homo sapiens
gccagcccgaggagcaucgguggc

SEQ ID NO: 41095 - RNA, 22 nt, Homo sapiens
ggcaaggucagcaccugggcca

SEQ ID NO: 41096 - RNA, 21 nt, Homo sapiens
uacauauauauauauauauau

SEQ ID NO: 41097 - RNA, 22 nt, Homo sapiens
uauauauauacuuuauauauau

SEQ ID NO: 41098 - RNA, 22 nt, Homo sapiens
uauauauauauauauauguaua

SEQ ID NO: 41099 - RNA, 24 nt, Homo sapiens
uauauauauauauauauguauaua

SEQ ID NO: 41100 - RNA, 22 nt, Homo sapiens
uauauauauauauauguauaua

SEQ ID NO: 41101 - RNA, 24 nt, Homo sapiens
uauauauauauauauguauauaua

SEQ ID NO: 41102 - RNA, 22 nt, Homo sapiens
uauauauauauauguauauaua

SEQ ID NO: 41103 - RNA, 24 nt, Homo sapiens
uauauauauauauguauauauaua

SEQ ID NO: 41104 - RNA, 22 nt, Homo sapiens
uauauauauauguauauauaua

SEQ ID NO: 41105 - RNA, 19 nt, Homo sapiens
uauauauguauauauauac

SEQ ID NO: 41106 - RNA, 23 nt, Homo sapiens
cagggucucgcuauguugcccag

SEQ ID NO: 41107 - RNA, 16 nt, Homo sapiens
gaaauuaaacuuuggc

SEQ ID NO: 41108 - RNA, 15 nt, Homo sapiens
gcgguggcggcagca

SEQ ID NO: 41109 - RNA, 23 nt, Homo sapiens
ugcacaaagucucauacagcaga

SEQ ID NO: 41110 - RNA, 25 nt, Homo sapiens
uuuugcugucuucauaaauaaauua

SEQ ID NO: 41111 - RNA, 17 nt, Homo sapiens
gcgaggggcaggcuggc

SEQ ID NO: 41112 - RNA, 22 nt, Homo sapiens
ggagcggcuggccggacuggag

SEQ ID NO: 41113 - RNA, 22 nt, Homo sapiens
cgggaguuccgagagagagcgu

SEQ ID NO: 41114 - RNA, 20 nt, Homo sapiens
cgucgggggagguuucccga

SEQ ID NO: 41115 - RNA, 16 nt, Homo sapiens
cuggugagaaaggagg

SEQ ID NO: 41116 - RNA, 17 nt, Homo sapiens
gcgcuggcuacgggcgc

SEQ ID NO: 41117 - RNA, 17 nt, Homo sapiens
gggcgggaagccgggcc

SEQ ID NO: 41118 - RNA, 18 nt, Homo sapiens
cccaaacuguccuuaaua

SEQ ID NO: 41119 - RNA, 19 nt, Homo sapiens
acagccuucuugccagcca

SEQ ID NO: 41120 - RNA, 17 nt, Homo sapiens
aggcgagaagggggcac

SEQ ID NO: 41121 - RNA, 24 nt, Homo sapiens
agggaaggagagacagaacaccca

SEQ ID NO: 41122 - RNA, 21 nt, Homo sapiens
caacugcuaggggaaguuggg

SEQ ID NO: 41123 - RNA, 18 nt, Homo sapiens
cacccgcgagccugcccc

SEQ ID NO: 41124 - RNA, 18 nt, Homo sapiens
ccggggcugcggcggccu

SEQ ID NO: 41125 - RNA, 18 nt, Homo sapiens
cugcaacugcuaggggaa

SEQ ID NO: 41126 - RNA, 22 nt, Homo sapiens
cugcagccuagcacccuccuaa

SEQ ID NO: 41127 - RNA, 21 nt, Homo sapiens
cuuccggccugggcuggaguc

SEQ ID NO: 41128 - RNA, 16 nt, Homo sapiens
gauguggacaccucgg

SEQ ID NO: 41129 - RNA, 18 nt, Homo sapiens
ggaguggugggagggagg

SEQ ID NO: 41130 - RNA, 20 nt, Homo sapiens
ggccacacgcuggcggucac

SEQ ID NO: 41131 - RNA, 20 nt, Homo sapiens
ggcggcuggcggugcccagg

SEQ ID NO: 41132 - RNA, 15 nt, Homo sapiens
ggcugcggcggccug

SEQ ID NO: 41133 - RNA, 20 nt, Homo sapiens
gggcagaggaaaaauaccuu

SEQ ID NO: 41134 - RNA, 19 nt, Homo sapiens
gggucuggggagcuggggc

SEQ ID NO: 41135 - RNA, 20 nt, Homo sapiens
gguugggacggaggcagggc

SEQ ID NO: 41136 - RNA, 15 nt, Homo sapiens
uggcugcggggcugc

SEQ ID NO: 41137 - RNA, 15 nt, Homo sapiens
ugggguggaacagau

SEQ ID NO: 41138 - RNA, 19 nt, Homo sapiens
aaaaaccaaaacugagcag

SEQ ID NO: 41139 - RNA, 17 nt, Homo sapiens
agcuggcccgggaugcc

SEQ ID NO: 41140 - RNA, 20 nt, Homo sapiens
aggaagagagagagaggagg

SEQ ID NO: 41141 - RNA, 18 nt, Homo sapiens
gagacccagucuggaggg

SEQ ID NO: 41142 - RNA, 18 nt, Homo sapiens
gagugacccucacccuua

SEQ ID NO: 41143 - RNA, 22 nt, Homo sapiens
gcgccuuuggggugccgggaug

SEQ ID NO: 41144 - RNA, 20 nt, Homo sapiens
gcggugaggagaagaggagg

SEQ ID NO: 41145 - RNA, 24 nt, Homo sapiens
gcugagacuaaagcagggauagug

SEQ ID NO: 41146 - RNA, 18 nt, Homo sapiens
ggaagucugugggaaagg

SEQ ID NO: 41147 - RNA, 21 nt, Homo sapiens
ggacgagaagggaaggcaagg

SEQ ID NO: 41148 - RNA, 21 nt, Homo sapiens
ggacuggccacggcgcucagc

SEQ ID NO: 41149 - RNA, 17 nt, Homo sapiens
ggcagcggcggcggggg

SEQ ID NO: 41150 - RNA, 18 nt, Homo sapiens
ggggacuggccacggcgc

SEQ ID NO: 41151 - RNA, 19 nt, Homo sapiens
guccaguuggguugucagc

SEQ ID NO: 41152 - RNA, 16 nt, Homo sapiens
ugggaggguggguggc

SEQ ID NO: 41153 - RNA, 16 nt, Homo sapiens
ggaauuucugugacua

SEQ ID NO: 41154 - RNA, 19 nt, Homo sapiens
uccaggguccuucucuucu

SEQ ID NO: 41155 - RNA, 25 nt, Homo sapiens
uuucucaacuaucgaagauccuuca

SEQ ID NO: 41156 - RNA, 15 nt, Homo sapiens
cguggggugggcggg

SEQ ID NO: 41157 - RNA, 18 nt, Homo sapiens
gggcggagccuugggggc

SEQ ID NO: 41158 - RNA, 20 nt, Homo sapiens
caacgguguucacucgccgu

SEQ ID NO: 41159 - RNA, 14 nt, Homo sapiens
ccacaguccaguuu

SEQ ID NO: 41160 - RNA, 18 nt, Homo sapiens
cccuacugccuccaccac

SEQ ID NO: 41161 - RNA, 17 nt, Homo sapiens
uccggaauggagugccg

SEQ ID NO: 41162 - RNA, 18 nt, Homo sapiens
ucgccgagguguguuuuc

SEQ ID NO: 41163 - RNA, 16 nt, Homo sapiens
auuggauucaggugga

SEQ ID NO: 41164 - RNA, 17 nt, Homo sapiens
cccgccgcuccucggcc

SEQ ID NO: 41165 - RNA, 19 nt, Homo sapiens
ccugagcugggcgccugcu

SEQ ID NO: 41166 - RNA, 18 nt, Homo sapiens
gcaaauacauuuuccagg

SEQ ID NO: 41167 - RNA, 22 nt, Homo sapiens
gccugagcugggcgccugcugg

SEQ ID NO: 41168 - RNA, 22 nt, Homo sapiens
uaccacaguguaauuuuuuuuu

SEQ ID NO: 41169 - RNA, 20 nt, Homo sapiens
uagaaaacuuaaaaggaaga

SEQ ID NO: 41170 - RNA, 19 nt, Homo sapiens
ucaagccaaugcaaaaagu

SEQ ID NO: 41171 - RNA, 18 nt, Homo sapiens
uccaaauucuugugacuu

SEQ ID NO: 41172 - RNA, 22 nt, Homo sapiens
aacucaucugguguuuucuuaa

SEQ ID NO: 41173 - RNA, 17 nt, Homo sapiens
caaucucaaaguaucau

SEQ ID NO: 41174 - RNA, 21 nt, Homo sapiens
cuagugguauuugccccugac

SEQ ID NO: 41175 - RNA, 18 nt, Homo sapiens
gaagagagcaguaagaau

SEQ ID NO: 41176 - RNA, 17 nt, Homo sapiens
ugccccugaccaauggc

SEQ ID NO: 41177 - RNA, 21 nt, Homo sapiens
ccaugaggggcaggcgcacag

SEQ ID NO: 41178 - RNA, 20 nt, Homo sapiens
cuugggaaaggggggagggg

SEQ ID NO: 41179 - RNA, 15 nt, Homo sapiens
gggaaaggggggagg

SEQ ID NO: 41180 - RNA, 21 nt, Homo sapiens
gggggaaggaggagaggcuuc

SEQ ID NO: 41181 - RNA, 19 nt, Homo sapiens
aggggagagauuggccauc

SEQ ID NO: 41182 - RNA, 15 nt, Homo sapiens
ccccucggcgggagg

SEQ ID NO: 41183 - RNA, 14 nt, Homo sapiens
gcccccugggcgug

SEQ ID NO: 41184 - RNA, 18 nt, Homo sapiens
gccuguggguugggggcu

SEQ ID NO: 41185 - RNA, 20 nt, Homo sapiens
ggccuugucccgagcgggac

SEQ ID NO: 41186 - RNA, 21 nt, Homo sapiens
ucagaacaguaagaauuauca

SEQ ID NO: 41187 - RNA, 15 nt, Homo sapiens
ucuccuugguaccau

SEQ ID NO: 41188 - RNA, 18 nt, Homo sapiens
acauuuuguccuugggga

SEQ ID NO: 41189 - RNA, 20 nt, Homo sapiens
aggacacacagaggagguca

SEQ ID NO: 41190 - RNA, 20 nt, Homo sapiens
ccuuggggagaaaggacaca

SEQ ID NO: 41191 - RNA, 22 nt, Homo sapiens
ggaaucuugaguaaguuaucuc

SEQ ID NO: 41192 - RNA, 16 nt, Homo sapiens
uauuccacugugucuc

SEQ ID NO: 41193 - RNA, 16 nt, Homo sapiens
ucuguagcaucuccag

SEQ ID NO: 41194 - RNA, 18 nt, Homo sapiens
agcaccccccagggagga

SEQ ID NO: 41195 - RNA, 22 nt, Homo sapiens
agguggcuuuggugacugggug

SEQ ID NO: 41196 - RNA, 21 nt, Homo sapiens
cagccccaggcuuggacccug

SEQ ID NO: 41197 - RNA, 21 nt, Homo sapiens
gagggagaaggccacgucacc

SEQ ID NO: 41198 - RNA, 18 nt, Homo sapiens
gcucgggguggggcugcu

SEQ ID NO: 41199 - RNA, 16 nt, Homo sapiens
cgggccgggcuggagc

SEQ ID NO: 41200 - RNA, 21 nt, Homo sapiens
uggcuuuuaaauuccauaaaa

SEQ ID NO: 41201 - RNA, 21 nt, Homo sapiens
ugggaaaacaaagguuucaca

SEQ ID NO: 41202 - RNA, 19 nt, Homo sapiens
ugguaugaaaagaaguuug

SEQ ID NO: 41203 - RNA, 20 nt, Homo sapiens
aagaugcaacuuuccauugc

SEQ ID NO: 41204 - RNA, 23 nt, Homo sapiens
agaugaaauaaaggugaaagaga

SEQ ID NO: 41205 - RNA, 21 nt, Homo sapiens
agcugaacaaagucuucugcu

SEQ ID NO: 41206 - RNA, 23 nt, Homo sapiens
aggaagcaaugaugugguaacaa

SEQ ID NO: 41207 - RNA, 21 nt, Homo sapiens
agggauuuggauggauucuuc

SEQ ID NO: 41208 - RNA, 18 nt, Homo sapiens
auguuacugugugcaaag

SEQ ID NO: 41209 - RNA, 21 nt, Homo sapiens
auuauuucuaggggcuuccaa

SEQ ID NO: 41210 - RNA, 20 nt, Homo sapiens
caacaacaaaaaugugcacu

SEQ ID NO: 41211 - RNA, 23 nt, Homo sapiens
cacacagguuguaagcaugagcu

SEQ ID NO: 41212 - RNA, 15 nt, Homo sapiens
cacacuuugcuggaa

SEQ ID NO: 41213 - RNA, 26 nt, Homo sapiens
cagcagcagcagcagcaaaugacugu

SEQ ID NO: 41214 - RNA, 19 nt, Homo sapiens
cagguggaaaucuuuuucu

SEQ ID NO: 41215 - RNA, 18 nt, Homo sapiens
cauaaguuugagccaaaa

SEQ ID NO: 41216 - RNA, 18 nt, Homo sapiens
cauucuuccgucauuauu

SEQ ID NO: 41217 - RNA, 21 nt, Homo sapiens
cauuuucucauaaacuaugca

SEQ ID NO: 41218 - RNA, 21 nt, Homo sapiens
ccccagccucgaagaccuuuc

SEQ ID NO: 41219 - RNA, 21 nt, Homo sapiens
ccgcaucugugggcacaccug

SEQ ID NO: 41220 - RNA, 14 nt, Homo sapiens
ccuaaugcauccag

SEQ ID NO: 41221 - RNA, 23 nt, Homo sapiens
ccuccacuguucucugacugucc

SEQ ID NO: 41222 - RNA, 21 nt, Homo sapiens
ggauggaagauagaggauggc

SEQ ID NO: 41223 - RNA, 16 nt, Homo sapiens
gguggaaaucuuuuuc

SEQ ID NO: 41224 - RNA, 20 nt, Homo sapiens
gugacagguggaaaucuuuu

SEQ ID NO: 41225 - RNA, 23 nt, Homo sapiens
uaaauauuuucaacauuaagaua

SEQ ID NO: 41226 - RNA, 15 nt, Homo sapiens
uaagcccuucuccac

SEQ ID NO: 41227 - RNA, 21 nt, Homo sapiens
uacagcacagagccaccgcac

SEQ ID NO: 41228 - RNA, 18 nt, Homo sapiens
uauuguacauauuuuaaa

SEQ ID NO: 41229 - RNA, 16 nt, Homo sapiens
ucagagaggaaggcag

SEQ ID NO: 41230 - RNA, 27 nt, Homo sapiens
uccuggauguuagggguaugauuauag

SEQ ID NO: 41231 - RNA, 21 nt, Homo sapiens
ucuaugccauuucuguuaaaa

SEQ ID NO: 41232 - RNA, 21 nt, Homo sapiens
ucugcaacaacaaaaaugugc

SEQ ID NO: 41233 - RNA, 21 nt, Homo sapiens
ugaaggaagacauugcuuucu

SEQ ID NO: 41234 - RNA, 22 nt, Homo sapiens
ugaggcagguagagaaguaagg

SEQ ID NO: 41235 - RNA, 18 nt, Homo sapiens
uggccccuauuuccugcc

SEQ ID NO: 41236 - RNA, 16 nt, Homo sapiens
ugucucuccagcagag

SEQ ID NO: 41237 - RNA, 18 nt, Homo sapiens
uucauucccaccaaaugu

SEQ ID NO: 41238 - RNA, 20 nt, Homo sapiens
uuucuaggggcuuccaaagc

SEQ ID NO: 41239 - RNA, 18 nt, Homo sapiens
aggaucuucuacucagcc

SEQ ID NO: 41240 - RNA, 16 nt, Homo sapiens
caguugacauccugga

SEQ ID NO: 41241 - RNA, 17 nt, Homo sapiens
caucaagcucuagaugc

SEQ ID NO: 41242 - RNA, 22 nt, Homo sapiens
gcuaggacugucgggcagugcu

SEQ ID NO: 41243 - RNA, 17 nt, Homo sapiens
gcucuaguuaguggcuc

SEQ ID NO: 41244 - RNA, 16 nt, Homo sapiens
ggggagaggaggggag

SEQ ID NO: 41245 - RNA, 20 nt, Homo sapiens
gggguggggguguggaaggg

SEQ ID NO: 41246 - RNA, 18 nt, Homo sapiens
gguggggguguggaaggg

SEQ ID NO: 41247 - RNA, 21 nt, Homo sapiens
guccugucucauucccuagac

SEQ ID NO: 41248 - RNA, 19 nt, Homo sapiens
uaaguuacugacuuuaagg

SEQ ID NO: 41249 - RNA, 16 nt, Homo sapiens
ugaguuaggugaguua

SEQ ID NO: 41250 - RNA, 21 nt, Homo sapiens
uggcaugacuccagggcugcu

SEQ ID NO: 41251 - RNA, 19 nt, Homo sapiens
uggggggugguggccaggg

SEQ ID NO: 41252 - RNA, 18 nt, Homo sapiens
uggggguguggaagggac

SEQ ID NO: 41253 - RNA, 18 nt, Homo sapiens
uguuauagcuggagagga

SEQ ID NO: 41254 - RNA, 16 nt, Homo sapiens
uuuugcacucacuccc

SEQ ID NO: 41255 - RNA, 17 nt, Homo sapiens
aucgugguuccacucag

SEQ ID NO: 41256 - RNA, 16 nt, Homo sapiens
ggacacuuuuguaagg

SEQ ID NO: 41257 - RNA, 18 nt, Homo sapiens
ugacuuguagcaacggcc

SEQ ID NO: 41258 - RNA, 19 nt, Homo sapiens
ugucuguuucugguguggu

SEQ ID NO: 41259 - RNA, 25 nt, Homo sapiens
ugccuggccucccuguguacccgag

SEQ ID NO: 41260 - RNA, 19 nt, Homo sapiens
ugaucgucaguggauuuug

SEQ ID NO: 41261 - RNA, 20 nt, Homo sapiens
aauauauugaaaucuggaaa

SEQ ID NO: 41262 - RNA, 17 nt, Homo sapiens
agaaguuuguaacagac

SEQ ID NO: 41263 - RNA, 18 nt, Homo sapiens
agugccgacuguggcccg

SEQ ID NO: 41264 - RNA, 15 nt, Homo sapiens
auugaaaucuggaaa

SEQ ID NO: 41265 - RNA, 22 nt, Homo sapiens
aacagaugagauuauaugaaaa

SEQ ID NO: 41266 - RNA, 22 nt, Homo sapiens
aggcgggggcggcagcugcggc

SEQ ID NO: 41267 - RNA, 19 nt, Homo sapiens
gagggccgcggcgaggggc

SEQ ID NO: 41268 - RNA, 19 nt, Homo sapiens
ucuguuauaggcagagauu

SEQ ID NO: 41269 - RNA, 22 nt, Homo sapiens
ugaaauauuuauuuauaagguc

SEQ ID NO: 41270 - RNA, 22 nt, Homo sapiens
ugaaguccacucauccauguuc

SEQ ID NO: 41271 - RNA, 21 nt, Homo sapiens
aaaaauccaagaagugggaag

SEQ ID NO: 41272 - RNA, 17 nt, Homo sapiens
gagcgcggucuccgccc

SEQ ID NO: 41273 - RNA, 18 nt, Homo sapiens
gcgcggucuccgcccgcc

SEQ ID NO: 41274 - RNA, 20 nt, Homo sapiens
uaagugccuucuuaauagca

SEQ ID NO: 41275 - RNA, 15 nt, Homo sapiens
accgccgcagcgguu

SEQ ID NO: 41276 - RNA, 16 nt, Homo sapiens
ccacccccccaacccg

SEQ ID NO: 41277 - RNA, 18 nt, Homo sapiens
gcagccuauacuccacac

SEQ ID NO: 41278 - RNA, 16 nt, Homo sapiens
gccggagucccggcac

SEQ ID NO: 41279 - RNA, 18 nt, Homo sapiens
uccaucauggcuagaugc

SEQ ID NO: 41280 - RNA, 20 nt, Homo sapiens
uggaaacuguguggauggaa

SEQ ID NO: 41281 - RNA, 20 nt, Homo sapiens
uggaugggguagggcaggua

SEQ ID NO: 41282 - RNA, 19 nt, Homo sapiens
uggugguguuccucugccu

SEQ ID NO: 41283 - RNA, 19 nt, Homo sapiens
gcaauaaaaaaaaauaaau

SEQ ID NO: 41284 - RNA, 18 nt, Homo sapiens
aggaggggcagggaggga

SEQ ID NO: 41285 - RNA, 19 nt, Homo sapiens
aggcggucaucaaaagagg

SEQ ID NO: 41286 - RNA, 24 nt, Homo sapiens
cacccauccggguuagccgcuagg

SEQ ID NO: 41287 - RNA, 15 nt, Homo sapiens
gcgguggcagcagca

SEQ ID NO: 41288 - RNA, 23 nt, Homo sapiens
uggcagcagcaggggggaaaggg

SEQ ID NO: 41289 - RNA, 22 nt, Homo sapiens
acagagaguagucaaacugauu

SEQ ID NO: 41290 - RNA, 18 nt, Homo sapiens
acuacuuauagauucaua

SEQ ID NO: 41291 - RNA, 22 nt, Homo sapiens
agggcaauuuggaaacugucac

SEQ ID NO: 41292 - RNA, 20 nt, Homo sapiens
ccauuaaaagaggaugaguu

SEQ ID NO: 41293 - RNA, 19 nt, Homo sapiens
ggcuguaacgccauuggca

SEQ ID NO: 41294 - RNA, 18 nt, Homo sapiens
gggauuuuacuuaauaaa

SEQ ID NO: 41295 - RNA, 15 nt, Homo sapiens
uccgcaccagcucug

SEQ ID NO: 41296 - RNA, 18 nt, Homo sapiens
ugagacaguguugguggc

SEQ ID NO: 41297 - RNA, 17 nt, Homo sapiens
uuuuacuuaauaaaguu

SEQ ID NO: 41298 - RNA, 25 nt, Homo sapiens
agccacagaggccuaugggggccac

SEQ ID NO: 41299 - RNA, 21 nt, Homo sapiens
cacuuggaaaggagguggagc

SEQ ID NO: 41300 - RNA, 17 nt, Homo sapiens
gcagaaggggacaaucu

SEQ ID NO: 41301 - RNA, 21 nt, Homo sapiens
ugagugcucacuuggaaagga

SEQ ID NO: 41302 - RNA, 20 nt, Homo sapiens
ugggcuggugucuuuuccaa

SEQ ID NO: 41303 - RNA, 24 nt, Homo sapiens
cacaccaggggcccuccggagucg

SEQ ID NO: 41304 - RNA, 19 nt, Homo sapiens
gccugggcaggggagggcc

SEQ ID NO: 41305 - RNA, 17 nt, Homo sapiens
gguguagaugccaggcc

SEQ ID NO: 41306 - RNA, 21 nt, Homo sapiens
guccaaguaguaggugacacg

SEQ ID NO: 41307 - RNA, 18 nt, Homo sapiens
uagaugccaggccgguug

SEQ ID NO: 41308 - RNA, 17 nt, Homo sapiens
uaggaagcagugguguu

SEQ ID NO: 41309 - RNA, 20 nt, Homo sapiens
ugcucucuucaaagaggcag

SEQ ID NO: 41310 - RNA, 16 nt, Homo sapiens
uuugaacaauuccaac

SEQ ID NO: 41311 - RNA, 16 nt, Homo sapiens
aggcggcuuccgguuu

SEQ ID NO: 41312 - RNA, 20 nt, Homo sapiens
ucaggggcagacaguucagg

SEQ ID NO: 41313 - RNA, 17 nt, Homo sapiens
uuuuagacgcagguaca

SEQ ID NO: 41314 - RNA, 18 nt, Homo sapiens
aucucuuucccuuuguua

SEQ ID NO: 41315 - RNA, 22 nt, Homo sapiens
augugcugaugccuguagauaa

SEQ ID NO: 41316 - RNA, 17 nt, Homo sapiens
ggcaccaauuuuaucua

SEQ ID NO: 41317 - RNA, 18 nt, Homo sapiens
ucugggcugccgcagcuu

SEQ ID NO: 41318 - RNA, 18 nt, Homo sapiens
uuaguuuauagcauagga

SEQ ID NO: 41319 - RNA, 20 nt, Homo sapiens
uucuuuuucuucccacccac

SEQ ID NO: 41320 - RNA, 16 nt, Homo sapiens
uuucaggaggccugcu

SEQ ID NO: 41321 - RNA, 18 nt, Homo sapiens
aagggaaaagcaauggaa

SEQ ID NO: 41322 - RNA, 18 nt, Homo sapiens
acagccccugcucucaaa

SEQ ID NO: 41323 - RNA, 21 nt, Homo sapiens
acgaacagagggaggggaugg

SEQ ID NO: 41324 - RNA, 20 nt, Homo sapiens
agccuguaagagccaggccc

SEQ ID NO: 41325 - RNA, 20 nt, Homo sapiens
aggaacuguggccugggugg

SEQ ID NO: 41326 - RNA, 21 nt, Homo sapiens
agggaggggauggggaggggc

SEQ ID NO: 41327 - RNA, 21 nt, Homo sapiens
cacuuuggucacuucucccaa

SEQ ID NO: 41328 - RNA, 18 nt, Homo sapiens
cggugaccuccuccuucc

SEQ ID NO: 41329 - RNA, 18 nt, Homo sapiens
ggcaccagccaggacagc

SEQ ID NO: 41330 - RNA, 17 nt, Homo sapiens
ggcuugggaggcugucu

SEQ ID NO: 41331 - RNA, 25 nt, Homo sapiens
gggauggggaggggccacugcuggg

SEQ ID NO: 41332 - RNA, 18 nt, Homo sapiens
guggacccagacacagga

SEQ ID NO: 41333 - RNA, 17 nt, Homo sapiens
uggacgggagugaaggg

SEQ ID NO: 41334 - RNA, 17 nt, Homo sapiens
uggccgagugaccaggc

SEQ ID NO: 41335 - RNA, 21 nt, Homo sapiens
uccaacuguaggaugugcggc

SEQ ID NO: 41336 - RNA, 19 nt, Homo sapiens
uuauuggaacauggccucu

SEQ ID NO: 41337 - RNA, 19 nt, Homo sapiens
agggaggggcgacaagggg

SEQ ID NO: 41338 - RNA, 16 nt, Homo sapiens
cacacuucuccgggaa

SEQ ID NO: 41339 - RNA, 19 nt, Homo sapiens
cccggccgccgccccuccg

SEQ ID NO: 41340 - RNA, 21 nt, Homo sapiens
ccgccgccgccuccccggccg

SEQ ID NO: 41341 - RNA, 16 nt, Homo sapiens
cucugggagggagggg

SEQ ID NO: 41342 - RNA, 17 nt, Homo sapiens
uggcccugagagacagg

SEQ ID NO: 41343 - RNA, 21 nt, Homo sapiens
uuugccaucuuuuccacaaac

SEQ ID NO: 41344 - RNA, 17 nt, Homo sapiens
agguggaggggcucugg

SEQ ID NO: 41345 - RNA, 16 nt, Homo sapiens
ccggccaggggcgggg

SEQ ID NO: 41346 - RNA, 23 nt, Homo sapiens
cucgccucuggggccaaagcagg

SEQ ID NO: 41347 - RNA, 16 nt, Homo sapiens
gccagguuccagcugg

SEQ ID NO: 41348 - RNA, 22 nt, Homo sapiens
gcuggggcaggggucacgucgc

SEQ ID NO: 41349 - RNA, 20 nt, Homo sapiens
ggucccucgccucuggggcc

SEQ ID NO: 41350 - RNA, 16 nt, Homo sapiens
ucaggcagaacccggc

SEQ ID NO: 41351 - RNA, 19 nt, Homo sapiens
aagacuguggagggugggg

SEQ ID NO: 41352 - RNA, 22 nt, Homo sapiens
ccaacacugguguuugggaagc

SEQ ID NO: 41353 - RNA, 20 nt, Homo sapiens
cucgaaccaagccagauucc

SEQ ID NO: 41354 - RNA, 23 nt, Homo sapiens
gacacagaaaagcuccuaucucg

SEQ ID NO: 41355 - RNA, 20 nt, Homo sapiens
gccucuuggcgaacauucuc

SEQ ID NO: 41356 - RNA, 20 nt, Homo sapiens
gcgcggggucacguaguugc

SEQ ID NO: 41357 - RNA, 23 nt, Homo sapiens
ggcgagcugcuuucacagcaacc

SEQ ID NO: 41358 - RNA, 18 nt, Homo sapiens
gguguugggggacagcgg

SEQ ID NO: 41359 - RNA, 15 nt, Homo sapiens
guggaggguggggga

SEQ ID NO: 41360 - RNA, 20 nt, Homo sapiens
ucguccucgcccgccgccuc

SEQ ID NO: 41361 - RNA, 16 nt, Homo sapiens
uggcugaggagaggga

SEQ ID NO: 41362 - RNA, 20 nt, Homo sapiens
acaucagcuacaaaguuuug

SEQ ID NO: 41363 - RNA, 19 nt, Homo sapiens
gggggccgcagggcgccag

SEQ ID NO: 41364 - RNA, 16 nt, Homo sapiens
ggguggucucugacua

SEQ ID NO: 41365 - RNA, 19 nt, Homo sapiens
ucugagagaggucugaugg

SEQ ID NO: 41366 - RNA, 15 nt, Homo sapiens
ugaggagcugggugc

SEQ ID NO: 41367 - RNA, 19 nt, Homo sapiens
uggaugguacacaguucua

SEQ ID NO: 41368 - RNA, 23 nt, Homo sapiens
aauaaugucaaauuugauucacu

SEQ ID NO: 41369 - RNA, 21 nt, Homo sapiens
aggugccgggggauggggggg

SEQ ID NO: 41370 - RNA, 14 nt, Homo sapiens
cagccgccagcucc

SEQ ID NO: 41371 - RNA, 20 nt, Homo sapiens
ccccacccagaccuggguac

SEQ ID NO: 41372 - RNA, 20 nt, Homo sapiens
ccccugacuuggguacgugc

SEQ ID NO: 41373 - RNA, 16 nt, Homo sapiens
cccgugccccgaggcg

SEQ ID NO: 41374 - RNA, 18 nt, Homo sapiens
ccgucgccgauucacaca

SEQ ID NO: 41375 - RNA, 19 nt, Homo sapiens
ccuggccgugacacccgug

SEQ ID NO: 41376 - RNA, 19 nt, Homo sapiens
cggcccccaucucggcggc

SEQ ID NO: 41377 - RNA, 19 nt, Homo sapiens
cggcgggcgggacccggcg

SEQ ID NO: 41378 - RNA, 17 nt, Homo sapiens
gcccucagaaaggagga

SEQ ID NO: 41379 - RNA, 19 nt, Homo sapiens
gccgggggauggggggggg

SEQ ID NO: 41380 - RNA, 20 nt, Homo sapiens
gcggcagcggccacgaucgc

SEQ ID NO: 41381 - RNA, 22 nt, Homo sapiens
gcucugggcccugcggguggcc

SEQ ID NO: 41382 - RNA, 21 nt, Homo sapiens
gcuggaggcaggugcagugcu

SEQ ID NO: 41383 - RNA, 20 nt, Homo sapiens
gcugugcugugguggacgug

SEQ ID NO: 41384 - RNA, 21 nt, Homo sapiens
ggcggcugcggcucggcggcc

SEQ ID NO: 41385 - RNA, 17 nt, Homo sapiens
ggcuuccucguccccga

SEQ ID NO: 41386 - RNA, 18 nt, Homo sapiens
gggacccccuaccugccu

SEQ ID NO: 41387 - RNA, 18 nt, Homo sapiens
gggcgccgcaggggccca

SEQ ID NO: 41388 - RNA, 20 nt, Homo sapiens
gggucuuggaugaagaggug

SEQ ID NO: 41389 - RNA, 19 nt, Homo sapiens
gggugggguggcauggugg

SEQ ID NO: 41390 - RNA, 18 nt, Homo sapiens
ggguugggagcugggugg

SEQ ID NO: 41391 - RNA, 19 nt, Homo sapiens
guggacguggugguggacg

SEQ ID NO: 41392 - RNA, 19 nt, Homo sapiens
guggacgugucgguggugg

SEQ ID NO: 41393 - RNA, 20 nt, Homo sapiens
uccggccggcucuggcggcg

SEQ ID NO: 41394 - RNA, 19 nt, Homo sapiens
ugcccuuuuuggucagcag

SEQ ID NO: 41395 - RNA, 22 nt, Homo sapiens
ugccgggggauggggggggguc

SEQ ID NO: 41396 - RNA, 22 nt, Homo sapiens
uguccucugcuuggagggugcu

SEQ ID NO: 41397 - RNA, 19 nt, Homo sapiens
acacaguauagucucacaa

SEQ ID NO: 41398 - RNA, 17 nt, Homo sapiens
acagguuuacuuaaaaa

SEQ ID NO: 41399 - RNA, 20 nt, Homo sapiens
agaaaauagaauggauuuuc

SEQ ID NO: 41400 - RNA, 20 nt, Homo sapiens
ccugaagguaguaccacacc

SEQ ID NO: 41401 - RNA, 22 nt, Homo sapiens
ccuggguauuuuacagguuuac

SEQ ID NO: 41402 - RNA, 22 nt, Homo sapiens
gcaaagcuaauugcacggugcu

SEQ ID NO: 41403 - RNA, 20 nt, Homo sapiens
uaaaauguaguaaaaaauga

SEQ ID NO: 41404 - RNA, 20 nt, Homo sapiens
uaaguggacauaacauuaga

SEQ ID NO: 41405 - RNA, 18 nt, Homo sapiens
uauauuauaaaaucccag

SEQ ID NO: 41406 - RNA, 22 nt, Homo sapiens
uauguuuauuuguaaagcucaa

SEQ ID NO: 41407 - RNA, 27 nt, Homo sapiens
ccgccgcccgcucgguuagccgcuagg

SEQ ID NO: 41408 - RNA, 16 nt, Homo sapiens
cgcgcgcccgccgccc

SEQ ID NO: 41409 - RNA, 17 nt, Homo sapiens
gcucgcucgcagccucc

SEQ ID NO: 41410 - RNA, 22 nt, Homo sapiens
gcucgcucgcagccuccucgcc

SEQ ID NO: 41411 - RNA, 14 nt, Homo sapiens
aaaggaaagcggac

SEQ ID NO: 41412 - RNA, 20 nt, Homo sapiens
agcugaguggcacagggggc

SEQ ID NO: 41413 - RNA, 19 nt, Homo sapiens
aggagaaggggaagcgcca

SEQ ID NO: 41414 - RNA, 15 nt, Homo sapiens
ccacgccacgucgcc

SEQ ID NO: 41415 - RNA, 16 nt, Homo sapiens
ccagcacgguccucac

SEQ ID NO: 41416 - RNA, 21 nt, Homo sapiens
cccgcagaugacccgggggac

SEQ ID NO: 41417 - RNA, 21 nt, Homo sapiens
ccuccccgcuucuucccccuc

SEQ ID NO: 41418 - RNA, 23 nt, Homo sapiens
ccucggcgcgagcucccccgccc

SEQ ID NO: 41419 - RNA, 16 nt, Homo sapiens
cgggaggaggcggggg

SEQ ID NO: 41420 - RNA, 21 nt, Homo sapiens
gccaggaugggcuuggucgug

SEQ ID NO: 41421 - RNA, 17 nt, Homo sapiens
gccgaccgagagucggg

SEQ ID NO: 41422 - RNA, 18 nt, Homo sapiens
gcgcgcgcacucccgcug

SEQ ID NO: 41423 - RNA, 20 nt, Homo sapiens
gcggggcggagcugaguggc

SEQ ID NO: 41424 - RNA, 15 nt, Homo sapiens
ggcggugaggccccg

SEQ ID NO: 41425 - RNA, 25 nt, Homo sapiens
gggaggccgaccgagagucgggggc

SEQ ID NO: 41426 - RNA, 18 nt, Homo sapiens
ucuguacagaugguccag

SEQ ID NO: 41427 - RNA, 18 nt, Homo sapiens
ugggcaggaaaaagggga

SEQ ID NO: 41428 - RNA, 18 nt, Homo sapiens
uguuaaguaaacagauuu

SEQ ID NO: 41429 - RNA, 26 nt, Homo sapiens
aacuggucagaaaagauacugucaaa

SEQ ID NO: 41430 - RNA, 20 nt, Homo sapiens
aacugucccaucacaagaca

SEQ ID NO: 41431 - RNA, 17 nt, Homo sapiens
acggcaccaaagucaca

SEQ ID NO: 41432 - RNA, 19 nt, Homo sapiens
agaaugaaaaaaaaaauga

SEQ ID NO: 41433 - RNA, 18 nt, Homo sapiens
agccagccccaagcugcu

SEQ ID NO: 41434 - RNA, 20 nt, Homo sapiens
aggaaggacagaagggguua

SEQ ID NO: 41435 - RNA, 25 nt, Homo sapiens
aggaaggcaaaaaagggggcuggag

SEQ ID NO: 41436 - RNA, 19 nt, Homo sapiens
caauugacaguuuggggaa

SEQ ID NO: 41437 - RNA, 19 nt, Homo sapiens
caucaaacauuggucuggc

SEQ ID NO: 41438 - RNA, 18 nt, Homo sapiens
ccaggagauauauagaag

SEQ ID NO: 41439 - RNA, 18 nt, Homo sapiens
cccaaugaaacagacuuu

SEQ ID NO: 41440 - RNA, 22 nt, Homo sapiens
ccccagaacuagagcuuuccua

SEQ ID NO: 41441 - RNA, 18 nt, Homo sapiens
ccggccggcugcugcucg

SEQ ID NO: 41442 - RNA, 17 nt, Homo sapiens
cuguaucuguauuucca

SEQ ID NO: 41443 - RNA, 22 nt, Homo sapiens
gcuugguauuauucaguaaaac

SEQ ID NO: 41444 - RNA, 23 nt, Homo sapiens
ggagggagaaugaagaggaaaaa

SEQ ID NO: 41445 - RNA, 20 nt, Homo sapiens
ggagugaaaguguugggagg

SEQ ID NO: 41446 - RNA, 17 nt, Homo sapiens
gugccaucuaaggccag

SEQ ID NO: 41447 - RNA, 17 nt, Homo sapiens
guggggggaagagagac

SEQ ID NO: 41448 - RNA, 17 nt, Homo sapiens
ucagaaaagauacuguc

SEQ ID NO: 41449 - RNA, 19 nt, Homo sapiens
ucccaccgccuccaaaucu

SEQ ID NO: 41450 - RNA, 20 nt, Homo sapiens
ucuacacagucgcucuccgg

SEQ ID NO: 41451 - RNA, 22 nt, Homo sapiens
uggguguggggcaugauggggg

SEQ ID NO: 41452 - RNA, 26 nt, Homo sapiens
ccuucauuggcugagaaugaauuaac

SEQ ID NO: 41453 - RNA, 18 nt, Homo sapiens
ggccacauccacgggggc

SEQ ID NO: 41454 - RNA, 19 nt, Homo sapiens
uguggucccacacagggcc

SEQ ID NO: 41455 - RNA, 20 nt, Homo sapiens
aggaggcccaggacccucca

SEQ ID NO: 41456 - RNA, 19 nt, Homo sapiens
ccaaggauaagcagacagg

SEQ ID NO: 41457 - RNA, 21 nt, Homo sapiens
ggccacacaugccauggccac

SEQ ID NO: 41458 - RNA, 23 nt, Homo sapiens
aggucucaucuccuagaggccac

SEQ ID NO: 41459 - RNA, 20 nt, Homo sapiens
gcuaaguguugauauggugg

SEQ ID NO: 41460 - RNA, 17 nt, Homo sapiens
uaacauaaucuaauaau

SEQ ID NO: 41461 - RNA, 19 nt, Homo sapiens
uaaguguauguccaaagcu

SEQ ID NO: 41462 - RNA, 18 nt, Homo sapiens
ugaguuguuuaggaaccu

SEQ ID NO: 41463 - RNA, 23 nt, Homo sapiens
uuaguaguggagucagcugggcu

SEQ ID NO: 41464 - RNA, 21 nt, Homo sapiens
cauccacuguguccuugggug

SEQ ID NO: 41465 - RNA, 18 nt, Homo sapiens
cccagggccgacgcccgg

SEQ ID NO: 41466 - RNA, 18 nt, Homo sapiens
cccccagaagggcauaga

SEQ ID NO: 41467 - RNA, 20 nt, Homo sapiens
ccgccucccaaagugcuggg

SEQ ID NO: 41468 - RNA, 24 nt, Homo sapiens
ccgguagcgcauccugcccggccg

SEQ ID NO: 41469 - RNA, 18 nt, Homo sapiens
ccucccaaagugcugggg

SEQ ID NO: 41470 - RNA, 19 nt, Homo sapiens
gcugcaaaagaugcagaug

SEQ ID NO: 41471 - RNA, 24 nt, Homo sapiens
gggaaggggaggaggagaaaagca

SEQ ID NO: 41472 - RNA, 22 nt, Homo sapiens
uaagacaugauguggguuuuau

SEQ ID NO: 41473 - RNA, 18 nt, Homo sapiens
ucccaaggccuggacucu

SEQ ID NO: 41474 - RNA, 16 nt, Homo sapiens
uggcagaggcgcuuuu

SEQ ID NO: 41475 - RNA, 17 nt, Homo sapiens
uggcuuuccuauugcug

SEQ ID NO: 41476 - RNA, 21 nt, Homo sapiens
cuaccuguuuuacaauauggg

SEQ ID NO: 41477 - RNA, 19 nt, Homo sapiens
ccaguggcagcaaacugca

SEQ ID NO: 41478 - RNA, 20 nt, Homo sapiens
uucaauuuucaccacagcug

SEQ ID NO: 41479 - RNA, 23 nt, Homo sapiens
cauuaucauguaugugugugugu

SEQ ID NO: 41480 - RNA, 22 nt, Homo sapiens
cgcaagaguuuucuuuuccccu

SEQ ID NO: 41481 - RNA, 20 nt, Homo sapiens
gcucuuuccuuuucuuuuuc

SEQ ID NO: 41482 - RNA, 18 nt, Homo sapiens
guacaaaaucugcacgca

SEQ ID NO: 41483 - RNA, 29 nt, Homo sapiens
aggaggggcggggagaggaaggagcgggc

SEQ ID NO: 41484 - RNA, 22 nt, Homo sapiens
agggaggaggagaggccgcgcu

SEQ ID NO: 41485 - RNA, 19 nt, Homo sapiens
aggggcggggagaggaagg

SEQ ID NO: 41486 - RNA, 18 nt, Homo sapiens
caccacaccccacauccc

SEQ ID NO: 41487 - RNA, 16 nt, Homo sapiens
caccagccacacuccc

SEQ ID NO: 41488 - RNA, 21 nt, Homo sapiens
gaggaggggcggggagaggaa

SEQ ID NO: 41489 - RNA, 29 nt, Homo sapiens
gaggaggggcggggagaggaaggagcggc

SEQ ID NO: 41490 - RNA, 24 nt, Homo sapiens
gcggggagaggaaggagcgggaag

SEQ ID NO: 41491 - RNA, 17 nt, Homo sapiens
gggaggaggggcgggga

SEQ ID NO: 41492 - RNA, 18 nt, Homo sapiens
uagaugggggaugugggg

SEQ ID NO: 41493 - RNA, 20 nt, Homo sapiens
uuuccuuuuuuuccccuaca

SEQ ID NO: 41494 - RNA, 17 nt, Homo sapiens
acacagccucacacugc

SEQ ID NO: 41495 - RNA, 19 nt, Homo sapiens
aguagaccuaggagcagga

SEQ ID NO: 41496 - RNA, 20 nt, Homo sapiens
ccucugucccuggaucugag

SEQ ID NO: 41497 - RNA, 18 nt, Homo sapiens
cuggaucuggccccauuu

SEQ ID NO: 41498 - RNA, 14 nt, Homo sapiens
gcucuuuuuggggc

SEQ ID NO: 41499 - RNA, 21 nt, Homo sapiens
ggcuucagggaggcuggggcc

SEQ ID NO: 41500 - RNA, 20 nt, Homo sapiens
gggcauuucaggaucugagg

SEQ ID NO: 41501 - RNA, 19 nt, Homo sapiens
ggugauugguggugcaguu

SEQ ID NO: 41502 - RNA, 20 nt, Homo sapiens
ggugauugguggugcaguug

SEQ ID NO: 41503 - RNA, 17 nt, Homo sapiens
uccacagugggacgcca

SEQ ID NO: 41504 - RNA, 16 nt, Homo sapiens
uugguugaugagcuca

SEQ ID NO: 41505 - RNA, 18 nt, Homo sapiens
caccccgucaucacuccc

SEQ ID NO: 41506 - RNA, 16 nt, Homo sapiens
cagggcccugcccagc

SEQ ID NO: 41507 - RNA, 21 nt, Homo sapiens
ccuggcgggaggcgccccggg

SEQ ID NO: 41508 - RNA, 17 nt, Homo sapiens
cgggagccgcauggccg

SEQ ID NO: 41509 - RNA, 20 nt, Homo sapiens
gcggagcgcggggggcggcg

SEQ ID NO: 41510 - RNA, 22 nt, Homo sapiens
ggccgcgggcggguccacuggc

SEQ ID NO: 41511 - RNA, 18 nt, Homo sapiens
ggggcggagcgcgggggg

SEQ ID NO: 41512 - RNA, 21 nt, Homo sapiens
ggggcggagcgcggggggcgg

SEQ ID NO: 41513 - RNA, 21 nt, Homo sapiens
ggggggcggcgcgggccccag

SEQ ID NO: 41514 - RNA, 19 nt, Homo sapiens
ugaggagggccgcgggcgg

SEQ ID NO: 41515 - RNA, 19 nt, Homo sapiens
ugcccagcccuccagcccc

SEQ ID NO: 41516 - RNA, 23 nt, Homo sapiens
cgggggugcggggcgccggaccg

SEQ ID NO: 41517 - RNA, 15 nt, Homo sapiens
cugggcgcggaagcc

SEQ ID NO: 41518 - RNA, 22 nt, Homo sapiens
gcagacaugcgccuggcggggg

SEQ ID NO: 41519 - RNA, 18 nt, Homo sapiens
gcccgggguucggagcgc

SEQ ID NO: 41520 - RNA, 20 nt, Homo sapiens
ggcgggggcccgggcccggg

SEQ ID NO: 41521 - RNA, 16 nt, Homo sapiens
gggcccgggcccgggg

SEQ ID NO: 41522 - RNA, 20 nt, Homo sapiens
uagaacaugagaaaaaguga

SEQ ID NO: 41523 - RNA, 23 nt, Homo sapiens
aggggcgcgggggagcucggggg

SEQ ID NO: 41524 - RNA, 17 nt, Homo sapiens
ccggggcuggggcugau

SEQ ID NO: 41525 - RNA, 18 nt, Homo sapiens
ccggggcuggggcugauu

SEQ ID NO: 41526 - RNA, 19 nt, Homo sapiens
cgggggcggcggcggcgcu

SEQ ID NO: 41527 - RNA, 16 nt, Homo sapiens
gccgcgcgcucgcucg

SEQ ID NO: 41528 - RNA, 19 nt, Homo sapiens
gcucggggcaggcugaggc

SEQ ID NO: 41529 - RNA, 18 nt, Homo sapiens
gggcaggggcgcggggga

SEQ ID NO: 41530 - RNA, 20 nt, Homo sapiens
ggggaggggaaggggggggg

SEQ ID NO: 41531 - RNA, 19 nt, Homo sapiens
ggggcggcggcggcgcugg

SEQ ID NO: 41532 - RNA, 18 nt, Homo sapiens
gggggagcucgggggcgg

SEQ ID NO: 41533 - RNA, 21 nt, Homo sapiens
guuuuauugcaauuauuuaga

SEQ ID NO: 41534 - RNA, 21 nt, Homo sapiens
aacugcucucugcuguucccu

SEQ ID NO: 41535 - RNA, 21 nt, Homo sapiens
gccgggccugcuuagcuccuc

SEQ ID NO: 41536 - RNA, 20 nt, Homo sapiens
aauuuuuaaacauuuuuaaa

SEQ ID NO: 41537 - RNA, 20 nt, Homo sapiens
gagguugcagcagugagcca

SEQ ID NO: 41538 - RNA, 16 nt, Homo sapiens
uacuaguagacagaac

SEQ ID NO: 41539 - RNA, 19 nt, Homo sapiens
ugaaagguaaaccuaagac

SEQ ID NO: 41540 - RNA, 21 nt, Homo sapiens
ugaaaucguaaaacagcagca

SEQ ID NO: 41541 - RNA, 19 nt, Homo sapiens
uguacauuuugacauugcc

SEQ ID NO: 41542 - RNA, 15 nt, Homo sapiens
cacuggcaccugcag

SEQ ID NO: 41543 - RNA, 17 nt, Homo sapiens
ccggcucguggcucugg

SEQ ID NO: 41544 - RNA, 20 nt, Homo sapiens
cgcuggaagaugacgacccg

SEQ ID NO: 41545 - RNA, 17 nt, Homo sapiens
gggcagggagggggccc

SEQ ID NO: 41546 - RNA, 22 nt, Homo sapiens
uggcggugaacgcuuccuuucc

SEQ ID NO: 41547 - RNA, 20 nt, Homo sapiens
gccagcgguggccgcggccg

SEQ ID NO: 41548 - RNA, 21 nt, Homo sapiens
aguauuuuccaagcuuuuuga

SEQ ID NO: 41549 - RNA, 18 nt, Homo sapiens
auaaggcuuaagagagag

SEQ ID NO: 41550 - RNA, 19 nt, Homo sapiens
cuuugggccugggcacagu

SEQ ID NO: 41551 - RNA, 18 nt, Homo sapiens
gagaauggaauaggaaga

SEQ ID NO: 41552 - RNA, 14 nt, Homo sapiens
gcagcaccaacacg

SEQ ID NO: 41553 - RNA, 20 nt, Homo sapiens
ggaguguguaguauuuucca

SEQ ID NO: 41554 - RNA, 22 nt, Homo sapiens
ucgagaauggaauaggaagaac

SEQ ID NO: 41555 - RNA, 17 nt, Homo sapiens
ugcuacuucccuccuuu

SEQ ID NO: 41556 - RNA, 17 nt, Homo sapiens
agccguuggcgccgggc

SEQ ID NO: 41557 - RNA, 19 nt, Homo sapiens
aggcagcuggagcagcagu

SEQ ID NO: 41558 - RNA, 20 nt, Homo sapiens
aggcggauguccacguuggu

SEQ ID NO: 41559 - RNA, 24 nt, Homo sapiens
cagagggacaugcgacacaacgug

SEQ ID NO: 41560 - RNA, 17 nt, Homo sapiens
cagcccccucccauggg

SEQ ID NO: 41561 - RNA, 14 nt, Homo sapiens
cagcgucaggcgga

SEQ ID NO: 41562 - RNA, 19 nt, Homo sapiens
ccacgccuaugacagugcc

SEQ ID NO: 41563 - RNA, 19 nt, Homo sapiens
cccagcagugguggcgggg

SEQ ID NO: 41564 - RNA, 18 nt, Homo sapiens
ccggggccuagcgcccgg

SEQ ID NO: 41565 - RNA, 16 nt, Homo sapiens
cgcaguggccacggcg

SEQ ID NO: 41566 - RNA, 21 nt, Homo sapiens
cggaaggcgggaggugggagc

SEQ ID NO: 41567 - RNA, 21 nt, Homo sapiens
cggcagccccuagagccugug

SEQ ID NO: 41568 - RNA, 19 nt, Homo sapiens
cuuccggcccgcaccaguc

SEQ ID NO: 41569 - RNA, 21 nt, Homo sapiens
cuuccggcccgcaccaguccc

SEQ ID NO: 41570 - RNA, 17 nt, Homo sapiens
gacaugggguuucacca

SEQ ID NO: 41571 - RNA, 19 nt, Homo sapiens
gagggugagugggggacag

SEQ ID NO: 41572 - RNA, 19 nt, Homo sapiens
gcagcagccccccgacccg

SEQ ID NO: 41573 - RNA, 21 nt, Homo sapiens
gcuggagcagcaguguggcca

SEQ ID NO: 41574 - RNA, 23 nt, Homo sapiens
ggaagcagacggugaccuuggcg

SEQ ID NO: 41575 - RNA, 23 nt, Homo sapiens
ggaggugguggggcugggggugg

SEQ ID NO: 41576 - RNA, 21 nt, Homo sapiens
ggcugaccccaggcaggcgcc

SEQ ID NO: 41577 - RNA, 18 nt, Homo sapiens
gggcuggggguggcugga

SEQ ID NO: 41578 - RNA, 19 nt, Homo sapiens
ggggugguggagguggugg

SEQ ID NO: 41579 - RNA, 25 nt, Homo sapiens
ggugagggugagugggggacagagg

SEQ ID NO: 41580 - RNA, 20 nt, Homo sapiens
ggugguggggcugggggugg

SEQ ID NO: 41581 - RNA, 19 nt, Homo sapiens
gugagggugagugggggac

SEQ ID NO: 41582 - RNA, 17 nt, Homo sapiens
guggaagcugcagccac

SEQ ID NO: 41583 - RNA, 15 nt, Homo sapiens
guggagguggugggg

SEQ ID NO: 41584 - RNA, 16 nt, Homo sapiens
ucauaggagguggaga

SEQ ID NO: 41585 - RNA, 15 nt, Homo sapiens
ugggccagcccagcc

SEQ ID NO: 41586 - RNA, 21 nt, Homo sapiens
uguacaguauggacgccagug

SEQ ID NO: 41587 - RNA, 25 nt, Homo sapiens
ugucgggggagaaggugagggugag

SEQ ID NO: 41588 - RNA, 22 nt, Homo sapiens
ccagagcgcaugagcgagcggc

SEQ ID NO: 41589 - RNA, 21 nt, Homo sapiens
uuaaugcagcugugcucagaa

SEQ ID NO: 41590 - RNA, 17 nt, Homo sapiens
gcggggagaugggggag

SEQ ID NO: 41591 - RNA, 20 nt, Homo sapiens
ugcaggagccaccaccuggc

SEQ ID NO: 41592 - RNA, 18 nt, Homo sapiens
agaccacacccauguggc

SEQ ID NO: 41593 - RNA, 19 nt, Homo sapiens
gaacuccugaccucaugau

SEQ ID NO: 41594 - RNA, 17 nt, Homo sapiens
gccgggcccgccucccg

SEQ ID NO: 41595 - RNA, 15 nt, Homo sapiens
acgccggcgaugcgc

SEQ ID NO: 41596 - RNA, 20 nt, Homo sapiens
cacauuucugcaucuuggga

SEQ ID NO: 41597 - RNA, 23 nt, Homo sapiens
gcuccgggggcuccgaggguggc

SEQ ID NO: 41598 - RNA, 17 nt, Homo sapiens
gcucuccacggcgcgcg

SEQ ID NO: 41599 - RNA, 20 nt, Homo sapiens
gggagaaaagggaagcuggc

SEQ ID NO: 41600 - RNA, 21 nt, Homo sapiens
gggcgcggcgaguggcgggag

SEQ ID NO: 41601 - RNA, 16 nt, Homo sapiens
ggggauggcgcuuggc

SEQ ID NO: 41602 - RNA, 16 nt, Homo sapiens
gugcgcgccuggggag

SEQ ID NO: 41603 - RNA, 16 nt, Homo sapiens
cgaauucacaacucca

SEQ ID NO: 41604 - RNA, 20 nt, Homo sapiens
uucacaacuccaacgccgac

SEQ ID NO: 41605 - RNA, 25 nt, Homo sapiens
uuccaauaacacaaaauaugagguu

SEQ ID NO: 41606 - RNA, 18 nt, Homo sapiens
caguagaugggcaagucu

SEQ ID NO: 41607 - RNA, 19 nt, Homo sapiens
gaacuagaaaaccuggguc

SEQ ID NO: 41608 - RNA, 18 nt, Homo sapiens
aagaagacugagguccca

SEQ ID NO: 41609 - RNA, 16 nt, Homo sapiens
agccaccccaguuccg

SEQ ID NO: 41610 - RNA, 15 nt, Homo sapiens
cacacauaaccauag

SEQ ID NO: 41611 - RNA, 22 nt, Homo sapiens
cagagccaugcugugcaagugu

SEQ ID NO: 41612 - RNA, 19 nt, Homo sapiens
ccggcucccgcucuggauc

SEQ ID NO: 41613 - RNA, 17 nt, Homo sapiens
ccuuuucuuaaacugcg

SEQ ID NO: 41614 - RNA, 19 nt, Homo sapiens
ggaucccgccccggccucg

SEQ ID NO: 41615 - RNA, 19 nt, Homo sapiens
uccggaucccgcuccgagu

SEQ ID NO: 41616 - RNA, 19 nt, Homo sapiens
ccggaggcggcagcagagg

SEQ ID NO: 41617 - RNA, 18 nt, Homo sapiens
ccgucccucuugaaaaug

SEQ ID NO: 41618 - RNA, 14 nt, Homo sapiens
cucauaccucugug

SEQ ID NO: 41619 - RNA, 23 nt, Homo sapiens
gacuggccacagggacgcgcccg

SEQ ID NO: 41620 - RNA, 22 nt, Homo sapiens
uaccuuuaaaauuucucagcug

SEQ ID NO: 41621 - RNA, 19 nt, Homo sapiens
uccaccuccuccuccuccg

SEQ ID NO: 41622 - RNA, 19 nt, Homo sapiens
uggagaaguuuguaaguuc

SEQ ID NO: 41623 - RNA, 20 nt, Homo sapiens
uuaaaauuaguaccaaggaa

SEQ ID NO: 41624 - RNA, 16 nt, Homo sapiens
aaaagauguccgcuca

SEQ ID NO: 41625 - RNA, 21 nt, Homo sapiens
caacaucgauguggccaggca

SEQ ID NO: 41626 - RNA, 18 nt, Homo sapiens
agaggacagugcuugcug

SEQ ID NO: 41627 - RNA, 18 nt, Homo sapiens
agagggguggccuggggu

SEQ ID NO: 41628 - RNA, 17 nt, Homo sapiens
gagggguggccuggggu

SEQ ID NO: 41629 - RNA, 18 nt, Homo sapiens
gggccagguggggcuggg

SEQ ID NO: 41630 - RNA, 20 nt, Homo sapiens
ugggagagaagagggguggc

SEQ ID NO: 41631 - RNA, 16 nt, Homo sapiens
ugggagggaugggggc

SEQ ID NO: 41632 - RNA, 15 nt, Homo sapiens
agguggguggggcag

SEQ ID NO: 41633 - RNA, 23 nt, Homo sapiens
agguggguggggcagggcccagg

SEQ ID NO: 41634 - RNA, 22 nt, Homo sapiens
ccggcuccugcuuggcccggcc

SEQ ID NO: 41635 - RNA, 21 nt, Homo sapiens
gcucgggccaggagccagggu

SEQ ID NO: 41636 - RNA, 15 nt, Homo sapiens
ggaguggggugggag

SEQ ID NO: 41637 - RNA, 14 nt, Homo sapiens
uggaggugaaaggg

SEQ ID NO: 41638 - RNA, 17 nt, Homo sapiens
uuuauuguggcacugga

SEQ ID NO: 41639 - RNA, 19 nt, Homo sapiens
aaugaauaacugcucaaaa

SEQ ID NO: 41640 - RNA, 25 nt, Homo sapiens
gcaagcucuagucugugcuuaagug

SEQ ID NO: 41641 - RNA, 17 nt, Homo sapiens
ucccagauccuuuccag

SEQ ID NO: 41642 - RNA, 21 nt, Homo sapiens
ucggccccuaaauuggccagg

SEQ ID NO: 41643 - RNA, 18 nt, Homo sapiens
gccgcgacgcuccggccc

SEQ ID NO: 41644 - RNA, 17 nt, Homo sapiens
ugcccuggucuuguccc

SEQ ID NO: 41645 - RNA, 18 nt, Homo sapiens
ugucccggucucguccuc

SEQ ID NO: 41646 - RNA, 19 nt, Homo sapiens
uggauucagguuugagaua

SEQ ID NO: 41647 - RNA, 19 nt, Homo sapiens
aguuuaggcaaagguacuc

SEQ ID NO: 41648 - RNA, 20 nt, Homo sapiens
aucaacugcaagucugaggg

SEQ ID NO: 41649 - RNA, 20 nt, Homo sapiens
augugugugucuuauggggc

SEQ ID NO: 41650 - RNA, 18 nt, Homo sapiens
caggaagauauguauccg

SEQ ID NO: 41651 - RNA, 19 nt, Homo sapiens
cagugccaucuguccugcu

SEQ ID NO: 41652 - RNA, 23 nt, Homo sapiens
ccgcucgcgccgccgccccuccc

SEQ ID NO: 41653 - RNA, 19 nt, Homo sapiens
ucucuggagaugagggugg

SEQ ID NO: 41654 - RNA, 19 nt, Homo sapiens
ugacugcaacgcugaaaau

SEQ ID NO: 41655 - RNA, 18 nt, Homo sapiens
ugaguuaaaugaauauag

SEQ ID NO: 41656 - RNA, 21 nt, Homo sapiens
uuuuacauaucuggaccugcc

SEQ ID NO: 41657 - RNA, 17 nt, Homo sapiens
cacugucucacacacca

SEQ ID NO: 41658 - RNA, 23 nt, Homo sapiens
gacauuuuuuuaguaucuuugga

SEQ ID NO: 41659 - RNA, 22 nt, Homo sapiens
ggcaauguaaaaaaucuucaca

SEQ ID NO: 41660 - RNA, 18 nt, Homo sapiens
uaaagcacaaaaaagagg

SEQ ID NO: 41661 - RNA, 17 nt, Homo sapiens
uggaggacauuuuuuua

SEQ ID NO: 41662 - RNA, 22 nt, Homo sapiens
uggcuaaucagacaaacaauua

SEQ ID NO: 41663 - RNA, 19 nt, Homo sapiens
uuacauguuuaauacagug

SEQ ID NO: 41664 - RNA, 19 nt, Homo sapiens
uucacuugccuggaucuca

SEQ ID NO: 41665 - RNA, 17 nt, Homo sapiens
uucucaacucagcccuu

SEQ ID NO: 41666 - RNA, 23 nt, Homo sapiens
uugcauauuuaauaauucaacug

SEQ ID NO: 41667 - RNA, 17 nt, Homo sapiens
acugagaaaauguccuu

SEQ ID NO: 41668 - RNA, 14 nt, Homo sapiens
gauguguguaggaa

SEQ ID NO: 41669 - RNA, 18 nt, Homo sapiens
ggaaauauucugaugugu

SEQ ID NO: 41670 - RNA, 20 nt, Homo sapiens
ucuguuuuuccccaggaacu

SEQ ID NO: 41671 - RNA, 23 nt, Homo sapiens
ugcaggaagaggcuggcuggagg

SEQ ID NO: 41672 - RNA, 21 nt, Homo sapiens
uggaguaggucaaagucuccg

SEQ ID NO: 41673 - RNA, 20 nt, Homo sapiens
uuguuuucugucucgguaac

SEQ ID NO: 41674 - RNA, 19 nt, Homo sapiens
aacauuauauguuaguguu

SEQ ID NO: 41675 - RNA, 16 nt, Homo sapiens
gaacugucaacacugc

SEQ ID NO: 41676 - RNA, 18 nt, Homo sapiens
ucgugcuuugccuucauc

SEQ ID NO: 41677 - RNA, 18 nt, Homo sapiens
ugcacaagugagacaagu

SEQ ID NO: 41678 - RNA, 18 nt, Homo sapiens
ugcuauuguggaggaugc

SEQ ID NO: 41679 - RNA, 25 nt, Homo sapiens
caugguaucuuuacugggaauauua

SEQ ID NO: 41680 - RNA, 18 nt, Homo sapiens
cuuucucaaauggaucac

SEQ ID NO: 41681 - RNA, 14 nt, Homo sapiens
gcucaaguuaaauu

SEQ ID NO: 41682 - RNA, 18 nt, Homo sapiens
guuguagaaaauuauaca

SEQ ID NO: 41683 - RNA, 18 nt, Homo sapiens
uccgugggaagcugaggg

SEQ ID NO: 41684 - RNA, 14 nt, Homo sapiens
ugguuccaucauuu

SEQ ID NO: 41685 - RNA, 18 nt, Homo sapiens
uuauuagcugugaccuua

SEQ ID NO: 41686 - RNA, 19 nt, Homo sapiens
aggcaagaggacacggugu

SEQ ID NO: 41687 - RNA, 24 nt, Homo sapiens
ggaggagaaguccaucuggugggg

SEQ ID NO: 41688 - RNA, 20 nt, Homo sapiens
ggggagggggugcagugggg

SEQ ID NO: 41689 - RNA, 24 nt, Homo sapiens
ggggagggggugcagugggggugg

SEQ ID NO: 41690 - RNA, 19 nt, Homo sapiens
gggggugggucaggguggg

SEQ ID NO: 41691 - RNA, 19 nt, Homo sapiens
gguggguccaugcaggaag

SEQ ID NO: 41692 - RNA, 22 nt, Homo sapiens
uggggagggggugcaguggggg

SEQ ID NO: 41693 - RNA, 17 nt, Homo sapiens
aggggggccggggaccc

SEQ ID NO: 41694 - RNA, 21 nt, Homo sapiens
aggggggccggggaccccggc

SEQ ID NO: 41695 - RNA, 18 nt, Homo sapiens
cuccgccgccgccgccgc

SEQ ID NO: 41696 - RNA, 22 nt, Homo sapiens
gaaagugguggaggcgggggug

SEQ ID NO: 41697 - RNA, 16 nt, Homo sapiens
gagggggcuccucuca

SEQ ID NO: 41698 - RNA, 17 nt, Homo sapiens
gcuccgccgccgccgcc

SEQ ID NO: 41699 - RNA, 17 nt, Homo sapiens
ucaucgcaggguccggg

SEQ ID NO: 41700 - RNA, 22 nt, Homo sapiens
uggaaagugguggaggcggggg

SEQ ID NO: 41701 - RNA, 22 nt, Homo sapiens
agggaggggcggccagaggagc

SEQ ID NO: 41702 - RNA, 21 nt, Homo sapiens
gcuccggccugcucggcuccc

SEQ ID NO: 41703 - RNA, 16 nt, Homo sapiens
gggcguggcggggagg

SEQ ID NO: 41704 - RNA, 22 nt, Homo sapiens
caugugcaguggcccauaaaua

SEQ ID NO: 41705 - RNA, 15 nt, Homo sapiens
cccagagcgugcccc

SEQ ID NO: 41706 - RNA, 18 nt, Homo sapiens
cgcgccccgccccucgcc

SEQ ID NO: 41707 - RNA, 20 nt, Homo sapiens
gcgggcgggagggggcgagg

SEQ ID NO: 41708 - RNA, 21 nt, Homo sapiens
ggcaguaccaggagcucuggg

SEQ ID NO: 41709 - RNA, 15 nt, Homo sapiens
uagcaccaaaaagcc

SEQ ID NO: 41710 - RNA, 17 nt, Homo sapiens
ugguaggccggcgggcg

SEQ ID NO: 41711 - RNA, 17 nt, Homo sapiens
acucgggccgcgacucc

SEQ ID NO: 41712 - RNA, 19 nt, Homo sapiens
ccgggccggcggcgcggcg

SEQ ID NO: 41713 - RNA, 22 nt, Homo sapiens
cgcggcggaggcagcccugcag

SEQ ID NO: 41714 - RNA, 18 nt, Homo sapiens
ggccggcggcgcggcgga

SEQ ID NO: 41715 - RNA, 15 nt, Homo sapiens
ggcgcgcccgggagc

SEQ ID NO: 41716 - RNA, 17 nt, Homo sapiens
ggcuggcugcuggcgcc

SEQ ID NO: 41717 - RNA, 17 nt, Homo sapiens
aaggcuuugacuaugaa

SEQ ID NO: 41718 - RNA, 20 nt, Homo sapiens
uccauuuaaaaaauuuuuca

SEQ ID NO: 41719 - RNA, 20 nt, Homo sapiens
ugcaaguacagcuuuaaagc

SEQ ID NO: 41720 - RNA, 18 nt, Homo sapiens
aauuggauguugaaggca

SEQ ID NO: 41721 - RNA, 18 nt, Homo sapiens
aggcuugaauuuguuaau

SEQ ID NO: 41722 - RNA, 16 nt, Homo sapiens
ccuuggguaagagggg

SEQ ID NO: 41723 - RNA, 19 nt, Homo sapiens
cugcuuuaauuguuuuaac

SEQ ID NO: 41724 - RNA, 17 nt, Homo sapiens
gcaaacagcucuuucgc

SEQ ID NO: 41725 - RNA, 16 nt, Homo sapiens
guaagguuaaagggua

SEQ ID NO: 41726 - RNA, 17 nt, Homo sapiens
gugauucaaauacugcc

SEQ ID NO: 41727 - RNA, 22 nt, Homo sapiens
ucaccaaacuucuguucuuaga

SEQ ID NO: 41728 - RNA, 16 nt, Homo sapiens
uccaccguuuucaauc

SEQ ID NO: 41729 - RNA, 16 nt, Homo sapiens
ugaagacagaacaggg

SEQ ID NO: 41730 - RNA, 23 nt, Homo sapiens
acagggcggucugguaguccugg

SEQ ID NO: 41731 - RNA, 21 nt, Homo sapiens
aggcagggguccuuggauggg

SEQ ID NO: 41732 - RNA, 20 nt, Homo sapiens
ccuuagaaaaagcccuugag

SEQ ID NO: 41733 - RNA, 18 nt, Homo sapiens
ccuuggauggguccaggg

SEQ ID NO: 41734 - RNA, 18 nt, Homo sapiens
gagagcuccaaaccaauc

SEQ ID NO: 41735 - RNA, 20 nt, Homo sapiens
gauguuacuguacagcgugg

SEQ ID NO: 41736 - RNA, 21 nt, Homo sapiens
ggccagagaggcuugcuuggg

SEQ ID NO: 41737 - RNA, 19 nt, Homo sapiens
gggaaaaaguacagugugg

SEQ ID NO: 41738 - RNA, 19 nt, Homo sapiens
ggggaaaaaguacagugug

SEQ ID NO: 41739 - RNA, 18 nt, Homo sapiens
uaaauggucaauuuggga

SEQ ID NO: 41740 - RNA, 17 nt, Homo sapiens
uaagccaaugacuuccc

SEQ ID NO: 41741 - RNA, 19 nt, Homo sapiens
uagaaugucucugaaaaug

SEQ ID NO: 41742 - RNA, 19 nt, Homo sapiens
uaucauuguuuuucgaguu

SEQ ID NO: 41743 - RNA, 19 nt, Homo sapiens
ucaguauuuuauguguacu

SEQ ID NO: 41744 - RNA, 18 nt, Homo sapiens
ugguucacccuguuccua

SEQ ID NO: 41745 - RNA, 18 nt, Homo sapiens
uucaagagagaaaaaaaa

SEQ ID NO: 41746 - RNA, 19 nt, Homo sapiens
uucaagagagaaaaaaaau

SEQ ID NO: 41747 - RNA, 17 nt, Homo sapiens
uuguacauuuuccuaag

SEQ ID NO: 41748 - RNA, 18 nt, Homo sapiens
cacaagggggcacugugu

SEQ ID NO: 41749 - RNA, 18 nt, Homo sapiens
ccucugggucuggggaag

SEQ ID NO: 41750 - RNA, 18 nt, Homo sapiens
gggccugagggaggaggg

SEQ ID NO: 41751 - RNA, 21 nt, Homo sapiens
ggggcugggaccuggaccucu

SEQ ID NO: 41752 - RNA, 15 nt, Homo sapiens
ggggucaauuucaug

SEQ ID NO: 41753 - RNA, 18 nt, Homo sapiens
gggucugagggaggaggg

SEQ ID NO: 41754 - RNA, 19 nt, Homo sapiens
gggucuggggaaggagggg

SEQ ID NO: 41755 - RNA, 23 nt, Homo sapiens
ggucuggggaaggagggguuggg

SEQ ID NO: 41756 - RNA, 18 nt, Homo sapiens
ucucuuagacuuuauuuc

SEQ ID NO: 41757 - RNA, 25 nt, Homo sapiens
accacgacgggcgaugaacgcuauc

SEQ ID NO: 41758 - RNA, 20 nt, Homo sapiens
augagguuuuugucuugaaa

SEQ ID NO: 41759 - RNA, 20 nt, Homo sapiens
cauuuaugagguuuuugucu

SEQ ID NO: 41760 - RNA, 19 nt, Homo sapiens
ccguugaccacgacgggcg

SEQ ID NO: 41761 - RNA, 19 nt, Homo sapiens
cggucaguuuugugugccu

SEQ ID NO: 41762 - RNA, 17 nt, Homo sapiens
cuuuccaugcgugccac

SEQ ID NO: 41763 - RNA, 22 nt, Homo sapiens
ucaguuuugugugccucgcugg

SEQ ID NO: 41764 - RNA, 18 nt, Homo sapiens
ugaaugaguuuucuggug

SEQ ID NO: 41765 - RNA, 19 nt, Homo sapiens
ugguuucuguccugaauga

SEQ ID NO: 41766 - RNA, 19 nt, Homo sapiens
uguacuaagaagacauagu

SEQ ID NO: 41767 - RNA, 18 nt, Homo sapiens
uuuugccguacuucccag

SEQ ID NO: 41768 - RNA, 17 nt, Homo sapiens
aaucucaggccuguggc

SEQ ID NO: 41769 - RNA, 19 nt, Homo sapiens
gagggggugggggagagug

SEQ ID NO: 41770 - RNA, 18 nt, Homo sapiens
gcggggaggggguggggg

SEQ ID NO: 41771 - RNA, 20 nt, Homo sapiens
ggagggggugggggagagug

SEQ ID NO: 41772 - RNA, 17 nt, Homo sapiens
ggggagaaagggagggg

SEQ ID NO: 41773 - RNA, 19 nt, Homo sapiens
ggggagggggugggggaga

SEQ ID NO: 41774 - RNA, 23 nt, Homo sapiens
ggggagggggugggggagagugg

SEQ ID NO: 41775 - RNA, 19 nt, Homo sapiens
gggguggggaggguggagg

SEQ ID NO: 41776 - RNA, 17 nt, Homo sapiens
ggggaggggaguaggag

SEQ ID NO: 41777 - RNA, 16 nt, Homo sapiens
ggccgggggucccggg

SEQ ID NO: 41778 - RNA, 18 nt, Homo sapiens
ucucaccccucucaagag

SEQ ID NO: 41779 - RNA, 19 nt, Homo sapiens
aaaacccaaaacaaagaag

SEQ ID NO: 41780 - RNA, 18 nt, Homo sapiens
acuguuuggcuuugucaa

SEQ ID NO: 41781 - RNA, 18 nt, Homo sapiens
agaccuuuaaccaaauac

SEQ ID NO: 41782 - RNA, 18 nt, Homo sapiens
augauugauuuuucugga

SEQ ID NO: 41783 - RNA, 18 nt, Homo sapiens
cuauuucuugcccaauag

SEQ ID NO: 41784 - RNA, 19 nt, Homo sapiens
gggguguaugcuuuuucca

SEQ ID NO: 41785 - RNA, 21 nt, Homo sapiens
ugagagguuuguaaauuacuu

SEQ ID NO: 41786 - RNA, 20 nt, Homo sapiens
uggaagaaguguguggaggg

SEQ ID NO: 41787 - RNA, 22 nt, Homo sapiens
cagccggagcgcuaggggcugg

SEQ ID NO: 41788 - RNA, 17 nt, Homo sapiens
agcagguacuuaggcag

SEQ ID NO: 41789 - RNA, 20 nt, Homo sapiens
cucuggaugccagggagggg

SEQ ID NO: 41790 - RNA, 18 nt, Homo sapiens
gcucccaguucgcucugc

SEQ ID NO: 41791 - RNA, 17 nt, Homo sapiens
ggaauguccucugagug

SEQ ID NO: 41792 - RNA, 18 nt, Homo sapiens
ggaguucccagguguggc

SEQ ID NO: 41793 - RNA, 20 nt, Homo sapiens
ggccguugucccgaggccac

SEQ ID NO: 41794 - RNA, 21 nt, Homo sapiens
cucgcguucaggugccgacgc

SEQ ID NO: 41795 - RNA, 19 nt, Homo sapiens
ggcaggcagggggcggggc

SEQ ID NO: 41796 - RNA, 17 nt, Homo sapiens
acugaggacuggagagu

SEQ ID NO: 41797 - RNA, 18 nt, Homo sapiens
aggcuggagagcaggcag

SEQ ID NO: 41798 - RNA, 15 nt, Homo sapiens
aggggaggccuuggc

SEQ ID NO: 41799 - RNA, 20 nt, Homo sapiens
cagggcccugaguuccugcc

SEQ ID NO: 41800 - RNA, 18 nt, Homo sapiens
ggaaagcucuuucagagc

SEQ ID NO: 41801 - RNA, 20 nt, Homo sapiens
ugcugcuuuuccugguccuu

SEQ ID NO: 41802 - RNA, 20 nt, Homo sapiens
aggaagcaggcucaaggcag

SEQ ID NO: 41803 - RNA, 17 nt, Homo sapiens
aaaacauuaaaaugcgg

SEQ ID NO: 41804 - RNA, 21 nt, Homo sapiens
caccaugugagagccgcggcc

SEQ ID NO: 41805 - RNA, 17 nt, Homo sapiens
gaggacaaccaccaaag

SEQ ID NO: 41806 - RNA, 21 nt, Homo sapiens
gcagugcccacggagggcugc

SEQ ID NO: 41807 - RNA, 24 nt, Homo sapiens
ggcugccccaugucagggggucga

SEQ ID NO: 41808 - RNA, 22 nt, Homo sapiens
ggcuggggcggccaaacccggg

SEQ ID NO: 41809 - RNA, 19 nt, Homo sapiens
gggaaggcggggcuggggc

SEQ ID NO: 41810 - RNA, 22 nt, Homo sapiens
gggcggggaaggcggggcuggg

SEQ ID NO: 41811 - RNA, 17 nt, Homo sapiens
gucacgcggccugcucc

SEQ ID NO: 41812 - RNA, 22 nt, Homo sapiens
ugagagaggacagggagcaggg

SEQ ID NO: 41813 - RNA, 18 nt, Homo sapiens
ugcagacaaggcgccggc

SEQ ID NO: 41814 - RNA, 18 nt, Homo sapiens
uucugucccuccucugug

SEQ ID NO: 41815 - RNA, 17 nt, Homo sapiens
aaacagggaaaaguaca

SEQ ID NO: 41816 - RNA, 17 nt, Homo sapiens
accacgccgcccgccac

SEQ ID NO: 41817 - RNA, 18 nt, Homo sapiens
gccuaaccacgccgcccg

SEQ ID NO: 41818 - RNA, 19 nt, Homo sapiens
ggggugggaaucuggggag

SEQ ID NO: 41819 - RNA, 18 nt, Homo sapiens
ugagaggaacauugaggg

SEQ ID NO: 41820 - RNA, 18 nt, Homo sapiens
cagugcuuuauuaaagau

SEQ ID NO: 41821 - RNA, 17 nt, Homo sapiens
ggcuauaggugaauugu

SEQ ID NO: 41822 - RNA, 17 nt, Homo sapiens
uguggcagagggacccg

SEQ ID NO: 41823 - RNA, 19 nt, Homo sapiens
aaccagcugaccaguguga

SEQ ID NO: 41824 - RNA, 25 nt, Homo sapiens
acuugggccaaauguugcagauauc

SEQ ID NO: 41825 - RNA, 17 nt, Homo sapiens
ccucugccaugcagcac

SEQ ID NO: 41826 - RNA, 18 nt, Homo sapiens
ccuuguuuuugguuggcu

SEQ ID NO: 41827 - RNA, 18 nt, Homo sapiens
cucuuuuucucccauaca

SEQ ID NO: 41828 - RNA, 18 nt, Homo sapiens
gagggcugguggcugggg

SEQ ID NO: 41829 - RNA, 16 nt, Homo sapiens
ggccagcgggcgggcc

SEQ ID NO: 41830 - RNA, 20 nt, Homo sapiens
ggccccucccugagauggcc

SEQ ID NO: 41831 - RNA, 19 nt, Homo sapiens
ugguuggcuuuuguuguug

SEQ ID NO: 41832 - RNA, 22 nt, Homo sapiens
uuaauuuuauauaaaaauauuu

SEQ ID NO: 41833 - RNA, 21 nt, Homo sapiens
uuuggcaauauuuauuauaau

SEQ ID NO: 41834 - RNA, 21 nt, Homo sapiens
cauuuugucauguuaaacagg

SEQ ID NO: 41835 - RNA, 23 nt, Homo sapiens
cccggcuggggucucuaagcucc

SEQ ID NO: 41836 - RNA, 17 nt, Homo sapiens
cuccugaugagcuguag

SEQ ID NO: 41837 - RNA, 16 nt, Homo sapiens
gcugcgaucuccuccu

SEQ ID NO: 41838 - RNA, 24 nt, Homo sapiens
ucaggcagcucaggcgacagggug

SEQ ID NO: 41839 - RNA, 17 nt, Homo sapiens
ugcgaucuccuccugau

SEQ ID NO: 41840 - RNA, 18 nt, Homo sapiens
uggcauuccaccaggaua

SEQ ID NO: 41841 - RNA, 16 nt, Homo sapiens
accugucauuuuccaa

SEQ ID NO: 41842 - RNA, 19 nt, Homo sapiens
caucucuccucuucucagg

SEQ ID NO: 41843 - RNA, 24 nt, Homo sapiens
ccaacagcucuuccucucuuuucu

SEQ ID NO: 41844 - RNA, 19 nt, Homo sapiens
gccgcgguucccaguccuc

SEQ ID NO: 41845 - RNA, 21 nt, Homo sapiens
gcggauguggagagucaagag

SEQ ID NO: 41846 - RNA, 25 nt, Homo sapiens
gcucuuggucucugaaaucucacug

SEQ ID NO: 41847 - RNA, 24 nt, Homo sapiens
ggauagauuauugaauaauuguua

SEQ ID NO: 41848 - RNA, 17 nt, Homo sapiens
ggaucggacaaucagca

SEQ ID NO: 41849 - RNA, 24 nt, Homo sapiens
ggcagcggcgcccaggagcgggag

SEQ ID NO: 41850 - RNA, 17 nt, Homo sapiens
ggcaggcugagcacugg

SEQ ID NO: 41851 - RNA, 17 nt, Homo sapiens
guggcaucuuucucugc

SEQ ID NO: 41852 - RNA, 18 nt, Homo sapiens
uacagcacaggguaacca

SEQ ID NO: 41853 - RNA, 18 nt, Homo sapiens
uauacauucauucauugc

SEQ ID NO: 41854 - RNA, 14 nt, Homo sapiens
ucacaacugucuuu

SEQ ID NO: 41855 - RNA, 19 nt, Homo sapiens
ucagcaaacuuuacagcag

SEQ ID NO: 41856 - RNA, 18 nt, Homo sapiens
ucaggagguucuucgcug

SEQ ID NO: 41857 - RNA, 21 nt, Homo sapiens
ucagggacugucucauuggca

SEQ ID NO: 41858 - RNA, 20 nt, Homo sapiens
ucauuuuauaaaauaugucu

SEQ ID NO: 41859 - RNA, 19 nt, Homo sapiens
ugcacuauuguccuggugu

SEQ ID NO: 41860 - RNA, 24 nt, Homo sapiens
uguccugguguuauaggcacuguc

SEQ ID NO: 41861 - RNA, 21 nt, Homo sapiens
uguuuugaaaauagauguuuc

SEQ ID NO: 41862 - RNA, 16 nt, Homo sapiens
uuacuacauuaucaga

SEQ ID NO: 41863 - RNA, 22 nt, Homo sapiens
uucgcugucacuuguugcacuu

SEQ ID NO: 41864 - RNA, 18 nt, Homo sapiens
uuuuggauaaugcaugac

SEQ ID NO: 41865 - RNA, 21 nt, Homo sapiens
ugacgugggugccagucugga

SEQ ID NO: 41866 - RNA, 19 nt, Homo sapiens
cagaaacccaucuuuguau

SEQ ID NO: 41867 - RNA, 18 nt, Homo sapiens
cgagcagccacauggccg

SEQ ID NO: 41868 - RNA, 16 nt, Homo sapiens
acaguccuaucuuccg

SEQ ID NO: 41869 - RNA, 21 nt, Homo sapiens
agggggcuggggaggggcuug

SEQ ID NO: 41870 - RNA, 17 nt, Homo sapiens
ccagggccgggcccagg

SEQ ID NO: 41871 - RNA, 21 nt, Homo sapiens
gagugggguuggggcugggga

SEQ ID NO: 41872 - RNA, 22 nt, Homo sapiens
ggagagggggcuggggaggggc

SEQ ID NO: 41873 - RNA, 17 nt, Homo sapiens
gggcccagggagggagg

SEQ ID NO: 41874 - RNA, 21 nt, Homo sapiens
gggccuggggcuggggcuggg

SEQ ID NO: 41875 - RNA, 20 nt, Homo sapiens
gggcuggggaggggcuuggg

SEQ ID NO: 41876 - RNA, 21 nt, Homo sapiens
ggggcuggggcuggggcuggg

SEQ ID NO: 41877 - RNA, 25 nt, Homo sapiens
ggggcuggggcuggggcuggggcug

SEQ ID NO: 41878 - RNA, 17 nt, Homo sapiens
ugggaggacgacggggc

SEQ ID NO: 41879 - RNA, 20 nt, Homo sapiens
aagcaccagcagcaggucau

SEQ ID NO: 41880 - RNA, 19 nt, Homo sapiens
caccugaacuccaucagcu

SEQ ID NO: 41881 - RNA, 23 nt, Homo sapiens
cagcaacuucugggccagcucag

SEQ ID NO: 41882 - RNA, 19 nt, Homo sapiens
cgaagcaggucauagcagg

SEQ ID NO: 41883 - RNA, 19 nt, Homo sapiens
gcucaagcaccaugucugg

SEQ ID NO: 41884 - RNA, 17 nt, Homo sapiens
gggaccucggcggcggc

SEQ ID NO: 41885 - RNA, 20 nt, Homo sapiens
uagaugcccuuaagcccuga

SEQ ID NO: 41886 - RNA, 18 nt, Homo sapiens
uaggggaagcuggcaggg

SEQ ID NO: 41887 - RNA, 23 nt, Homo sapiens
ucggcggcggcggcggcagcggc

SEQ ID NO: 41888 - RNA, 18 nt, Homo sapiens
uguccaggugugguccag

SEQ ID NO: 41889 - RNA, 21 nt, Homo sapiens
uguccaggugugguccagccg

SEQ ID NO: 41890 - RNA, 16 nt, Homo sapiens
uguccuugaacugacc

SEQ ID NO: 41891 - RNA, 19 nt, Homo sapiens
acgagcccagccccgcccc

SEQ ID NO: 41892 - RNA, 16 nt, Homo sapiens
cggccacucccguagc

SEQ ID NO: 41893 - RNA, 18 nt, Homo sapiens
uagcugcugcagcugcug

SEQ ID NO: 41894 - RNA, 16 nt, Homo sapiens
acugugaagcagagau

SEQ ID NO: 41895 - RNA, 21 nt, Homo sapiens
ccuguuccaaaugauccuaug

SEQ ID NO: 41896 - RNA, 19 nt, Homo sapiens
cugguggggccaggcuugg

SEQ ID NO: 41897 - RNA, 15 nt, Homo sapiens
cuguucuugacucuc

SEQ ID NO: 41898 - RNA, 21 nt, Homo sapiens
gaagcuguuucugcucugugg

SEQ ID NO: 41899 - RNA, 22 nt, Homo sapiens
ggaggggcaacgcucacuuggu

SEQ ID NO: 41900 - RNA, 22 nt, Homo sapiens
ggcuuggagugguaguggaggu

SEQ ID NO: 41901 - RNA, 20 nt, Homo sapiens
uaaggaaaauacaaggggcc

SEQ ID NO: 41902 - RNA, 17 nt, Homo sapiens
ucuagcaacauuccuua

SEQ ID NO: 41903 - RNA, 18 nt, Homo sapiens
ucucugauucucuguucu

SEQ ID NO: 41904 - RNA, 22 nt, Homo sapiens
ucuggagcagggggaggaagaa

SEQ ID NO: 41905 - RNA, 18 nt, Homo sapiens
gcccaugggguggggaca

SEQ ID NO: 41906 - RNA, 18 nt, Homo sapiens
ucacagguaagcacagcc

SEQ ID NO: 41907 - RNA, 17 nt, Homo sapiens
acauugauuggcuggug

SEQ ID NO: 41908 - RNA, 20 nt, Homo sapiens
cagaguccgccuccgucgcc

SEQ ID NO: 41909 - RNA, 19 nt, Homo sapiens
cugucgcccccugcagccu

SEQ ID NO: 41910 - RNA, 18 nt, Homo sapiens
gaggagacagggggcuca

SEQ ID NO: 41911 - RNA, 19 nt, Homo sapiens
gggcugagguggggcuggg

SEQ ID NO: 41912 - RNA, 17 nt, Homo sapiens
caacaggccuuccuccu

SEQ ID NO: 41913 - RNA, 22 nt, Homo sapiens
cauacccaguugugauuuccag

SEQ ID NO: 41914 - RNA, 19 nt, Homo sapiens
ccucccugcuauuagauac

SEQ ID NO: 41915 - RNA, 25 nt, Homo sapiens
cucaguuuuccagcauagcugcagg

SEQ ID NO: 41916 - RNA, 22 nt, Homo sapiens
uaacgcugacgagacgguggcc

SEQ ID NO: 41917 - RNA, 20 nt, Homo sapiens
agaaucucaauacuuuccug

SEQ ID NO: 41918 - RNA, 22 nt, Homo sapiens
aggagguggcggcgggagcggg

SEQ ID NO: 41919 - RNA, 20 nt, Homo sapiens
ccgccuccaucuccucgccc

SEQ ID NO: 41920 - RNA, 20 nt, Homo sapiens
gcggacccgcuccuucggag

SEQ ID NO: 41921 - RNA, 17 nt, Homo sapiens
gcggcgacgcguggcgg

SEQ ID NO: 41922 - RNA, 23 nt, Homo sapiens
gcggcgggagcgggcugcgcggc

SEQ ID NO: 41923 - RNA, 18 nt, Homo sapiens
gcggcugcaggaaggggc

SEQ ID NO: 41924 - RNA, 18 nt, Homo sapiens
ggagggcggcaggggagg

SEQ ID NO: 41925 - RNA, 20 nt, Homo sapiens
ggcgccccugcccggggagg

SEQ ID NO: 41926 - RNA, 22 nt, Homo sapiens
gggaggagguggcggcgggagc

SEQ ID NO: 41927 - RNA, 25 nt, Homo sapiens
gggaggagguggcggcgggagcggg

SEQ ID NO: 41928 - RNA, 15 nt, Homo sapiens
gggcgcggcgacgcg

SEQ ID NO: 41929 - RNA, 20 nt, Homo sapiens
gggcgcggcgacgcguggcg

SEQ ID NO: 41930 - RNA, 19 nt, Homo sapiens
ggggagcgguggggcuugc

SEQ ID NO: 41931 - RNA, 21 nt, Homo sapiens
ggggagcgguggggcuugcgg

SEQ ID NO: 41932 - RNA, 23 nt, Homo sapiens
ggggaggagguggcggcgggagc

SEQ ID NO: 41933 - RNA, 25 nt, Homo sapiens
ggggaggagguggcggcgggagcgg

SEQ ID NO: 41934 - RNA, 19 nt, Homo sapiens
ggggaggggagacuggagc

SEQ ID NO: 41935 - RNA, 18 nt, Homo sapiens
uacccgcggcggacccgc

SEQ ID NO: 41936 - RNA, 14 nt, Homo sapiens
uacccuccaaagca

SEQ ID NO: 41937 - RNA, 18 nt, Homo sapiens
uguagcaacauucaaugu

SEQ ID NO: 41938 - RNA, 21 nt, Homo sapiens
uucaaggcucccuuuguagca

SEQ ID NO: 41939 - RNA, 22 nt, Homo sapiens
acccaacccgggcccguggugc

SEQ ID NO: 41940 - RNA, 23 nt, Homo sapiens
acuccagccccgucuggugaccc

SEQ ID NO: 41941 - RNA, 19 nt, Homo sapiens
ccggccccugggcuucggc

SEQ ID NO: 41942 - RNA, 15 nt, Homo sapiens
gccucccuccugggg

SEQ ID NO: 41943 - RNA, 18 nt, Homo sapiens
uggcacgagguccugcag

SEQ ID NO: 41944 - RNA, 23 nt, Homo sapiens
agcagcggggugggggugggggg

SEQ ID NO: 41945 - RNA, 17 nt, Homo sapiens
aggaaugagaauugcua

SEQ ID NO: 41946 - RNA, 19 nt, Homo sapiens
cacuuggauccuuuuauca

SEQ ID NO: 41947 - RNA, 21 nt, Homo sapiens
caugccugccuuccccacccc

SEQ ID NO: 41948 - RNA, 20 nt, Homo sapiens
ccauggcaaugaggaucccg

SEQ ID NO: 41949 - RNA, 19 nt, Homo sapiens
cccgccgcauccccuaccc

SEQ ID NO: 41950 - RNA, 16 nt, Homo sapiens
gcccuugggcugcacc

SEQ ID NO: 41951 - RNA, 22 nt, Homo sapiens
ggagugggggacccggguuagc

SEQ ID NO: 41952 - RNA, 19 nt, Homo sapiens
ggccacaccccaugccugc

SEQ ID NO: 41953 - RNA, 18 nt, Homo sapiens
guguuaggggcauccauc

SEQ ID NO: 41954 - RNA, 18 nt, Homo sapiens
ugagagaaguggggguag

SEQ ID NO: 41955 - RNA, 17 nt, Homo sapiens
acagcaguuaucauacu

SEQ ID NO: 41956 - RNA, 16 nt, Homo sapiens
cacagccaccagaauu

SEQ ID NO: 41957 - RNA, 20 nt, Homo sapiens
cuaguuuucaauacuagcca

SEQ ID NO: 41958 - RNA, 20 nt, Homo sapiens
guauauauaccuuucucauu

SEQ ID NO: 41959 - RNA, 19 nt, Homo sapiens
uaacauaguauauauaccu

SEQ ID NO: 41960 - RNA, 19 nt, Homo sapiens
uagaucugacuuguuuuca

SEQ ID NO: 41961 - RNA, 18 nt, Homo sapiens
uccacaucaaccauauaa

SEQ ID NO: 41962 - RNA, 18 nt, Homo sapiens
uccucuuggcuacacaaa

SEQ ID NO: 41963 - RNA, 19 nt, Homo sapiens
uuaguuucaagcucgcuaa

SEQ ID NO: 41964 - RNA, 17 nt, Homo sapiens
ccccagccccuccuucc

SEQ ID NO: 41965 - RNA, 18 nt, Homo sapiens
ccuuuacaaaauggggcc

SEQ ID NO: 41966 - RNA, 22 nt, Homo sapiens
uacacagguggguagguuauau

SEQ ID NO: 41967 - RNA, 18 nt, Homo sapiens
uguggacuuaccacauuu

SEQ ID NO: 41968 - RNA, 24 nt, Homo sapiens
aagaaaauauaugagaauuuacuu

SEQ ID NO: 41969 - RNA, 22 nt, Homo sapiens
aauauauauauauauaaaauau

SEQ ID NO: 41970 - RNA, 17 nt, Homo sapiens
accacaaaagcaaauaa

SEQ ID NO: 41971 - RNA, 18 nt, Homo sapiens
aguauuauguauguguag

SEQ ID NO: 41972 - RNA, 22 nt, Homo sapiens
auauauaaauauauauauauau

SEQ ID NO: 41973 - RNA, 22 nt, Homo sapiens
auauauauaaauauauauauau

SEQ ID NO: 41974 - RNA, 22 nt, Homo sapiens
auauauauauaaauauauauau

SEQ ID NO: 41975 - RNA, 21 nt, Homo sapiens
auauauauauauauaaaauau

SEQ ID NO: 41976 - RNA, 21 nt, Homo sapiens
aucauccucgucccuugucca

SEQ ID NO: 41977 - RNA, 18 nt, Homo sapiens
cgcucuuuccuucucucg

SEQ ID NO: 41978 - RNA, 21 nt, Homo sapiens
gcaaccuaauuuaguagagac

SEQ ID NO: 41979 - RNA, 18 nt, Homo sapiens
guguacguauaaauaucu

SEQ ID NO: 41980 - RNA, 17 nt, Homo sapiens
uaaacuucuaagugcag

SEQ ID NO: 41981 - RNA, 21 nt, Homo sapiens
uagaguccaaucaucaguucc

SEQ ID NO: 41982 - RNA, 23 nt, Homo sapiens
uagcuuucugccuacuauauaga

SEQ ID NO: 41983 - RNA, 19 nt, Homo sapiens
uaguuaauuuuacugcuuc

SEQ ID NO: 41984 - RNA, 22 nt, Homo sapiens
uauauaaauauauauauauaua

SEQ ID NO: 41985 - RNA, 22 nt, Homo sapiens
uauauauaaauauauauauaua

SEQ ID NO: 41986 - RNA, 26 nt, Homo sapiens
uauauauaaauauauauauauauaua

SEQ ID NO: 41987 - RNA, 22 nt, Homo sapiens
uauauauauaaauauauauaua

SEQ ID NO: 41988 - RNA, 22 nt, Homo sapiens
uauauauauauaaauauauaua

SEQ ID NO: 41989 - RNA, 22 nt, Homo sapiens
uauauauauauauaaauauaua

SEQ ID NO: 41990 - RNA, 20 nt, Homo sapiens
aaaaauucgaucuuuuucuc

SEQ ID NO: 41991 - RNA, 23 nt, Homo sapiens
agugaagaaucguaaguucuggu

SEQ ID NO: 41992 - RNA, 20 nt, Homo sapiens
auauguauauacauauauau

SEQ ID NO: 41993 - RNA, 19 nt, Homo sapiens
cgaucuuuuucucuuaggu

SEQ ID NO: 41994 - RNA, 16 nt, Homo sapiens
gacuguacgcgcgcgc

SEQ ID NO: 41995 - RNA, 25 nt, Homo sapiens
gcgcggcggcggcuucggccgcggc

SEQ ID NO: 41996 - RNA, 18 nt, Homo sapiens
uaauagauuugacugcua

SEQ ID NO: 41997 - RNA, 19 nt, Homo sapiens
uauguauauacauauauau

SEQ ID NO: 41998 - RNA, 15 nt, Homo sapiens
uccacaaucgucaga

SEQ ID NO: 41999 - RNA, 17 nt, Homo sapiens
ucccgggcuccggcgcg

SEQ ID NO: 42000 - RNA, 23 nt, Homo sapiens
uccugggcacugcuucucccggg

SEQ ID NO: 42001 - RNA, 22 nt, Homo sapiens
ugauauguauauacauauauau

SEQ ID NO: 42002 - RNA, 17 nt, Homo sapiens
ugcuguacucacagucu

SEQ ID NO: 42003 - RNA, 20 nt, Homo sapiens
uggaaagcauuucuucuugg

SEQ ID NO: 42004 - RNA, 17 nt, Homo sapiens
uggagcucggcgugcgc

SEQ ID NO: 42005 - RNA, 16 nt, Homo sapiens
uggcacaacugcgggg

SEQ ID NO: 42006 - RNA, 20 nt, Homo sapiens
uggguggcgcggaggguggc

SEQ ID NO: 42007 - RNA, 18 nt, Homo sapiens
ugucccgggcuccggcgc

SEQ ID NO: 42008 - RNA, 17 nt, Homo sapiens
uucacuuuuuuuucacc

SEQ ID NO: 42009 - RNA, 18 nt, Homo sapiens
uuggaaagcauuucuucu

SEQ ID NO: 42010 - RNA, 20 nt, Homo sapiens
auuaagguuggaaaucauga

SEQ ID NO: 42011 - RNA, 20 nt, Homo sapiens
auugauuuauuugggaacua

SEQ ID NO: 42012 - RNA, 18 nt, Homo sapiens
cauagacccaauuuuuaa

SEQ ID NO: 42013 - RNA, 16 nt, Homo sapiens
caugaggaaggacaca

SEQ ID NO: 42014 - RNA, 15 nt, Homo sapiens
gaagaaggcacagag

SEQ ID NO: 42015 - RNA, 20 nt, Homo sapiens
ggcagaaggccggcccagag

SEQ ID NO: 42016 - RNA, 22 nt, Homo sapiens
guuauguuuaucacaaaacaaa

SEQ ID NO: 42017 - RNA, 22 nt, Homo sapiens
uagagacuguuggcaaguuaug

SEQ ID NO: 42018 - RNA, 19 nt, Homo sapiens
agagggggcgcagggcagg

SEQ ID NO: 42019 - RNA, 18 nt, Homo sapiens
gaggagccaagguguccc

SEQ ID NO: 42020 - RNA, 18 nt, Homo sapiens
gggggugguaggaagggg

SEQ ID NO: 42021 - RNA, 19 nt, Homo sapiens
ggggugguaggaaggggug

SEQ ID NO: 42022 - RNA, 16 nt, Homo sapiens
uaacugcugaagcucu

SEQ ID NO: 42023 - RNA, 19 nt, Homo sapiens
aacuggcacauguggaagc

SEQ ID NO: 42024 - RNA, 17 nt, Homo sapiens
ccuggccucgguccccc

SEQ ID NO: 42025 - RNA, 18 nt, Homo sapiens
gcggcugcgcccggccug

SEQ ID NO: 42026 - RNA, 16 nt, Homo sapiens
ggcugcgcccggccug

SEQ ID NO: 42027 - RNA, 23 nt, Homo sapiens
ucaagaugcuuuuauuagaauac

SEQ ID NO: 42028 - RNA, 17 nt, Homo sapiens
agauuugggaaauuugg

SEQ ID NO: 42029 - RNA, 20 nt, Homo sapiens
auauauuuuauaaauaucua

SEQ ID NO: 42030 - RNA, 16 nt, Homo sapiens
cgagagcacgacucgg

SEQ ID NO: 42031 - RNA, 18 nt, Homo sapiens
ggugccaccugcuggagc

SEQ ID NO: 42032 - RNA, 23 nt, Homo sapiens
ugggaaauuugggagacuuguuc

SEQ ID NO: 42033 - RNA, 21 nt, Homo sapiens
ccuccuccuccucuuacaguc

SEQ ID NO: 42034 - RNA, 14 nt, Homo sapiens
gaggcccgcguuca

SEQ ID NO: 42035 - RNA, 22 nt, Homo sapiens
ucacaguggguggguuucuuca

SEQ ID NO: 42036 - RNA, 24 nt, Homo sapiens
ugggcaguauucuccagcucccgc

SEQ ID NO: 42037 - RNA, 18 nt, Homo sapiens
agcaggguagagcuccuc

SEQ ID NO: 42038 - RNA, 18 nt, Homo sapiens
agccagcccugggauugg

SEQ ID NO: 42039 - RNA, 21 nt, Homo sapiens
agggcugcuggggcuugaggg

SEQ ID NO: 42040 - RNA, 21 nt, Homo sapiens
agguugccggguucuuaaggc

SEQ ID NO: 42041 - RNA, 19 nt, Homo sapiens
cuguuccccuaggagccag

SEQ ID NO: 42042 - RNA, 23 nt, Homo sapiens
gaagaaggcagagguugccgggu

SEQ ID NO: 42043 - RNA, 18 nt, Homo sapiens
gccucgguucggcggggc

SEQ ID NO: 42044 - RNA, 22 nt, Homo sapiens
gcuggggcuugaggggguggug

SEQ ID NO: 42045 - RNA, 21 nt, Homo sapiens
uucacauuucacuggcuuugg

SEQ ID NO: 42046 - RNA, 18 nt, Homo sapiens
uuuucccaagccccucag

SEQ ID NO: 42047 - RNA, 19 nt, Homo sapiens
aguacuuguauuuggagaa

SEQ ID NO: 42048 - RNA, 16 nt, Homo sapiens
cccgccgccucuugcc

SEQ ID NO: 42049 - RNA, 18 nt, Homo sapiens
cccgccgccucuugccgc

SEQ ID NO: 42050 - RNA, 21 nt, Homo sapiens
ccgccaccggcucccgccgcc

SEQ ID NO: 42051 - RNA, 26 nt, Homo sapiens
ccgccgcccgucccccgggccgggcu

SEQ ID NO: 42052 - RNA, 21 nt, Homo sapiens
ccgccggggucccgcuauccc

SEQ ID NO: 42053 - RNA, 16 nt, Homo sapiens
ccgcgcccggggcucg

SEQ ID NO: 42054 - RNA, 18 nt, Homo sapiens
cgcccggggcucggucug

SEQ ID NO: 42055 - RNA, 19 nt, Homo sapiens
ggcucccgccgccucuugc

SEQ ID NO: 42056 - RNA, 19 nt, Homo sapiens
ugcacaugcugugaugaag

SEQ ID NO: 42057 - RNA, 22 nt, Homo sapiens
uucccguacguuugcuggaagg

SEQ ID NO: 42058 - RNA, 20 nt, Homo sapiens
ccaggcugagacacgugccc

SEQ ID NO: 42059 - RNA, 21 nt, Homo sapiens
cccagccccuguuguucucuc

SEQ ID NO: 42060 - RNA, 17 nt, Homo sapiens
ccuuugugugaaugagc

SEQ ID NO: 42061 - RNA, 15 nt, Homo sapiens
cucuacgcuggugag

SEQ ID NO: 42062 - RNA, 21 nt, Homo sapiens
gcagcgcccauuccaacacag

SEQ ID NO: 42063 - RNA, 21 nt, Homo sapiens
ggcacuucugggcacagccac

SEQ ID NO: 42064 - RNA, 17 nt, Homo sapiens
gggugggaggaggagga

SEQ ID NO: 42065 - RNA, 20 nt, Homo sapiens
uaagaaaagcuaaauuuaua

SEQ ID NO: 42066 - RNA, 19 nt, Homo sapiens
uauccuucaucccugucgc

SEQ ID NO: 42067 - RNA, 19 nt, Homo sapiens
ucccagccccugaugggca

SEQ ID NO: 42068 - RNA, 17 nt, Homo sapiens
ucuaggaggaggaagaa

SEQ ID NO: 42069 - RNA, 21 nt, Homo sapiens
ugauaggggacccaguuaucu

SEQ ID NO: 42070 - RNA, 19 nt, Homo sapiens
uguuacuaacacacuugag

SEQ ID NO: 42071 - RNA, 20 nt, Homo sapiens
aggugggcucuggcagcggg

SEQ ID NO: 42072 - RNA, 16 nt, Homo sapiens
ccggccgccguagccc

SEQ ID NO: 42073 - RNA, 17 nt, Homo sapiens
gccggccgccguagccc

SEQ ID NO: 42074 - RNA, 18 nt, Homo sapiens
gccugcugucgccauccc

SEQ ID NO: 42075 - RNA, 18 nt, Homo sapiens
ccagcuugggcaacagaa

SEQ ID NO: 42076 - RNA, 17 nt, Homo sapiens
aaagcuuuaagcauucc

SEQ ID NO: 42077 - RNA, 17 nt, Homo sapiens
ccaguauaugcacaaca

SEQ ID NO: 42078 - RNA, 18 nt, Homo sapiens
ccauuagaugccaggugc

SEQ ID NO: 42079 - RNA, 19 nt, Homo sapiens
uaaaaugcuacugagaaga

SEQ ID NO: 42080 - RNA, 21 nt, Homo sapiens
uacauuauuaacuuuuucaag

SEQ ID NO: 42081 - RNA, 20 nt, Homo sapiens
uagccuuucaccaaaacugg

SEQ ID NO: 42082 - RNA, 22 nt, Homo sapiens
ugggaagacaaaguacaaacau

SEQ ID NO: 42083 - RNA, 18 nt, Homo sapiens
ugguuccaaauuaucuaa

SEQ ID NO: 42084 - RNA, 18 nt, Homo sapiens
ccagcucggccgcccccc

SEQ ID NO: 42085 - RNA, 19 nt, Homo sapiens
cgccgucggggcccggagc

SEQ ID NO: 42086 - RNA, 18 nt, Homo sapiens
gaccgggaggucagagga

SEQ ID NO: 42087 - RNA, 19 nt, Homo sapiens
gacgcuggcgcgcgagggg

SEQ ID NO: 42088 - RNA, 19 nt, Homo sapiens
guugggccgaacagcagau

SEQ ID NO: 42089 - RNA, 21 nt, Homo sapiens
uagaggcaggggcacaugcag

SEQ ID NO: 42090 - RNA, 15 nt, Homo sapiens
ugccccagggaucca

SEQ ID NO: 42091 - RNA, 19 nt, Homo sapiens
ugcccugagccagcgggcc

SEQ ID NO: 42092 - RNA, 19 nt, Homo sapiens
acagaugggguugacaaaa

SEQ ID NO: 42093 - RNA, 22 nt, Homo sapiens
accagcaugggcagcucagagg

SEQ ID NO: 42094 - RNA, 22 nt, Homo sapiens
aggagcuggagauccccauuag

SEQ ID NO: 42095 - RNA, 22 nt, Homo sapiens
cugguugugaauagggagagcc

SEQ ID NO: 42096 - RNA, 18 nt, Homo sapiens
gaggggaaccccaggaag

SEQ ID NO: 42097 - RNA, 21 nt, Homo sapiens
gcacugguugugaauagggag

SEQ ID NO: 42098 - RNA, 21 nt, Homo sapiens
ggaaagggaacacauuacuuu

SEQ ID NO: 42099 - RNA, 21 nt, Homo sapiens
ucaaacugugcacugguugug

SEQ ID NO: 42100 - RNA, 20 nt, Homo sapiens
ugagggguggaaggagagga

SEQ ID NO: 42101 - RNA, 16 nt, Homo sapiens
ugccugaguagaggaa

SEQ ID NO: 42102 - RNA, 20 nt, Homo sapiens
uggaaggagaggaagucugg

SEQ ID NO: 42103 - RNA, 19 nt, Homo sapiens
aagcuguugggagccagga

SEQ ID NO: 42104 - RNA, 18 nt, Homo sapiens
aucucuucccaguucauc

SEQ ID NO: 42105 - RNA, 15 nt, Homo sapiens
cacccugcaagcccc

SEQ ID NO: 42106 - RNA, 22 nt, Homo sapiens
gagggcccuggacccucuguuc

SEQ ID NO: 42107 - RNA, 18 nt, Homo sapiens
gcuggcccuuucagggac

SEQ ID NO: 42108 - RNA, 19 nt, Homo sapiens
ggccacagucagcuggggc

SEQ ID NO: 42109 - RNA, 23 nt, Homo sapiens
uggagguacugggggaacugaug

SEQ ID NO: 42110 - RNA, 22 nt, Homo sapiens
agaagggggugggggaggcaag

SEQ ID NO: 42111 - RNA, 20 nt, Homo sapiens
agggggugggggaggcaagg

SEQ ID NO: 42112 - RNA, 19 nt, Homo sapiens
ggggugggggaggcaaggg

SEQ ID NO: 42113 - RNA, 20 nt, Homo sapiens
ugggcacuuacagaagggca

SEQ ID NO: 42114 - RNA, 27 nt, Homo sapiens
ugggucacugcaaagaucacuaugggc

SEQ ID NO: 42115 - RNA, 23 nt, Homo sapiens
uuaaaguuuucucccucaaacca

SEQ ID NO: 42116 - RNA, 16 nt, Homo sapiens
aagggugccgggcccu

SEQ ID NO: 42117 - RNA, 20 nt, Homo sapiens
acccaugacacucugugugg

SEQ ID NO: 42118 - RNA, 18 nt, Homo sapiens
caguggcgggacuucagc

SEQ ID NO: 42119 - RNA, 21 nt, Homo sapiens
ccucuccucccucucccgauc

SEQ ID NO: 42120 - RNA, 15 nt, Homo sapiens
ccugugcgaggccag

SEQ ID NO: 42121 - RNA, 23 nt, Homo sapiens
ccuuggccucccaaagagcuggg

SEQ ID NO: 42122 - RNA, 18 nt, Homo sapiens
gaaaacacagaacuuuau

SEQ ID NO: 42123 - RNA, 18 nt, Homo sapiens
ggccugcacccacagacc

SEQ ID NO: 42124 - RNA, 22 nt, Homo sapiens
ggucucaauuuccugaccuugu

SEQ ID NO: 42125 - RNA, 22 nt, Homo sapiens
ggugugugcgcgccugugcgag

SEQ ID NO: 42126 - RNA, 20 nt, Homo sapiens
gugagccacagcacccagcc

SEQ ID NO: 42127 - RNA, 24 nt, Homo sapiens
uauuccaucguccccuggaagucu

SEQ ID NO: 42128 - RNA, 15 nt, Homo sapiens
ugacucuucuuuaca

SEQ ID NO: 42129 - RNA, 23 nt, Homo sapiens
ugagccccuugugagaaggaaaa

SEQ ID NO: 42130 - RNA, 18 nt, Homo sapiens
ccuuuauuuugaucaccu

SEQ ID NO: 42131 - RNA, 17 nt, Homo sapiens
gcccuguggggcggggg

SEQ ID NO: 42132 - RNA, 17 nt, Homo sapiens
ugcugcguggaaaaaac

SEQ ID NO: 42133 - RNA, 18 nt, Homo sapiens
ugggggagggcgcgagaa

SEQ ID NO: 42134 - RNA, 19 nt, Homo sapiens
ugucccccaccccucccuc

SEQ ID NO: 42135 - RNA, 15 nt, Homo sapiens
uguccuugcccugug

SEQ ID NO: 42136 - RNA, 20 nt, Homo sapiens
aaacauuagcuuauacacga

SEQ ID NO: 42137 - RNA, 19 nt, Homo sapiens
aacauucuuggagacagga

SEQ ID NO: 42138 - RNA, 22 nt, Homo sapiens
aucagcuucgauaagugccuuu

SEQ ID NO: 42139 - RNA, 20 nt, Homo sapiens
caaguggcagaacgaucugg

SEQ ID NO: 42140 - RNA, 19 nt, Homo sapiens
caucucaauauuggcuucu

SEQ ID NO: 42141 - RNA, 23 nt, Homo sapiens
ccuaggcugugaggacuaauucu

SEQ ID NO: 42142 - RNA, 18 nt, Homo sapiens
gaagacaggaaaauaaaa

SEQ ID NO: 42143 - RNA, 18 nt, Homo sapiens
gagcagaugcgguuggcg

SEQ ID NO: 42144 - RNA, 18 nt, Homo sapiens
gcagagaaucuuuuuacu

SEQ ID NO: 42145 - RNA, 19 nt, Homo sapiens
gggcaccugccaggcucgc

SEQ ID NO: 42146 - RNA, 15 nt, Homo sapiens
ucacggaaacgcuac

SEQ ID NO: 42147 - RNA, 24 nt, Homo sapiens
uccucggccucccaaaauauuggg

SEQ ID NO: 42148 - RNA, 19 nt, Homo sapiens
uguaauaauucucuugcuu

SEQ ID NO: 42149 - RNA, 19 nt, Homo sapiens
uucagguuggggccugaga

SEQ ID NO: 42150 - RNA, 19 nt, Homo sapiens
uucuucaaggccuucuguc

SEQ ID NO: 42151 - RNA, 21 nt, Homo sapiens
agcaccccagcagccgguagc

SEQ ID NO: 42152 - RNA, 17 nt, Homo sapiens
caaagucacaaauauug

SEQ ID NO: 42153 - RNA, 19 nt, Homo sapiens
cacaguuucuaagcauguc

SEQ ID NO: 42154 - RNA, 16 nt, Homo sapiens
gaggugguaaucuucu

SEQ ID NO: 42155 - RNA, 24 nt, Homo sapiens
uaaaaaaaaaaaaagagagacauu

SEQ ID NO: 42156 - RNA, 22 nt, Homo sapiens
ugagguggcagcugcccagaau

SEQ ID NO: 42157 - RNA, 21 nt, Homo sapiens
aggaaguugaucagggaacag

SEQ ID NO: 42158 - RNA, 19 nt, Homo sapiens
gaacaggaauuugggaaca

SEQ ID NO: 42159 - RNA, 23 nt, Homo sapiens
ccggcuccgguuccggcugcggc

SEQ ID NO: 42160 - RNA, 23 nt, Homo sapiens
ccggcucuggcucuggcugcggc

SEQ ID NO: 42161 - RNA, 23 nt, Homo sapiens
ccggcugcggcuccggcucuggc

SEQ ID NO: 42162 - RNA, 24 nt, Homo sapiens
ccugccccgcggcuccggcuccgg

SEQ ID NO: 42163 - RNA, 20 nt, Homo sapiens
cggcuccggcuccgguuccg

SEQ ID NO: 42164 - RNA, 20 nt, Homo sapiens
cgggcuagggcucgggcucc

SEQ ID NO: 42165 - RNA, 19 nt, Homo sapiens
cuccugccccgcggcuccg

SEQ ID NO: 42166 - RNA, 20 nt, Homo sapiens
gccccgcggcuccggcuccg

SEQ ID NO: 42167 - RNA, 21 nt, Homo sapiens
gccccgcggcuccggcuccgg

SEQ ID NO: 42168 - RNA, 24 nt, Homo sapiens
gcuccgguuccggcugcggcuccg

SEQ ID NO: 42169 - RNA, 19 nt, Homo sapiens
gcucuggcugcggcucggg

SEQ ID NO: 42170 - RNA, 17 nt, Homo sapiens
uggcucuggcugcggcu

SEQ ID NO: 42171 - RNA, 17 nt, Homo sapiens
aggccucugaggcuucc

SEQ ID NO: 42172 - RNA, 22 nt, Homo sapiens
cagaaguguggaagccuggagu

SEQ ID NO: 42173 - RNA, 18 nt, Homo sapiens
uagagcugggucgggggc

SEQ ID NO: 42174 - RNA, 18 nt, Homo sapiens
ugccgcaggucgcugucg

SEQ ID NO: 42175 - RNA, 14 nt, Homo sapiens
gacuggaagugcag

SEQ ID NO: 42176 - RNA, 17 nt, Homo sapiens
aacauggagcuccgacc

SEQ ID NO: 42177 - RNA, 19 nt, Homo sapiens
acggcagcuccugccgagc

SEQ ID NO: 42178 - RNA, 19 nt, Homo sapiens
agccugagccaccgcccuc

SEQ ID NO: 42179 - RNA, 22 nt, Homo sapiens
agcucgcacgcugagccagggc

SEQ ID NO: 42180 - RNA, 22 nt, Homo sapiens
cagcggggguggccacggcagc

SEQ ID NO: 42181 - RNA, 15 nt, Homo sapiens
cgcggagggguggac

SEQ ID NO: 42182 - RNA, 20 nt, Homo sapiens
gguggccacggcagcuccug

SEQ ID NO: 42183 - RNA, 17 nt, Homo sapiens
ugggcagcggggguggc

SEQ ID NO: 42184 - RNA, 18 nt, Homo sapiens
caccccaccacaacugcc

SEQ ID NO: 42185 - RNA, 24 nt, Homo sapiens
cccaagcaggugugggagggcggg

SEQ ID NO: 42186 - RNA, 19 nt, Homo sapiens
cccgaagcccagccccugg

SEQ ID NO: 42187 - RNA, 21 nt, Homo sapiens
ggagggcggggcaaguguggg

SEQ ID NO: 42188 - RNA, 17 nt, Homo sapiens
uggcaccagcaccagcc

SEQ ID NO: 42189 - RNA, 20 nt, Homo sapiens
acuugccuuuuguuuuucaa

SEQ ID NO: 42190 - RNA, 18 nt, Homo sapiens
aggggaagggagaggugc

SEQ ID NO: 42191 - RNA, 18 nt, Homo sapiens
ccccggcuuggagugcaa

SEQ ID NO: 42192 - RNA, 16 nt, Homo sapiens
cgaggugggcaagggg

SEQ ID NO: 42193 - RNA, 15 nt, Homo sapiens
cgcuggaggcagccg

SEQ ID NO: 42194 - RNA, 19 nt, Homo sapiens
gcugauaacagggacacgc

SEQ ID NO: 42195 - RNA, 19 nt, Homo sapiens
gggaggaggggaagggaga

SEQ ID NO: 42196 - RNA, 20 nt, Homo sapiens
gugguuagacuauguauucu

SEQ ID NO: 42197 - RNA, 19 nt, Homo sapiens
ugauaggaucgcccccuug

SEQ ID NO: 42198 - RNA, 18 nt, Homo sapiens
accaaccacaacauaaaa

SEQ ID NO: 42199 - RNA, 16 nt, Homo sapiens
agcccgcgcccuccuu

SEQ ID NO: 42200 - RNA, 27 nt, Homo sapiens
auauauauauaacuguauauauauaua

SEQ ID NO: 42201 - RNA, 16 nt, Homo sapiens
cacccccaugcaaacc

SEQ ID NO: 42202 - RNA, 20 nt, Homo sapiens
cccgaguggggcuggcuccc

SEQ ID NO: 42203 - RNA, 18 nt, Homo sapiens
ccucccggccgccggcgc

SEQ ID NO: 42204 - RNA, 19 nt, Homo sapiens
ccuccuuucuucuucuguc

SEQ ID NO: 42205 - RNA, 17 nt, Homo sapiens
ccuggcccagcuccucg

SEQ ID NO: 42206 - RNA, 24 nt, Homo sapiens
gccagcccugggugcucuggucac

SEQ ID NO: 42207 - RNA, 21 nt, Homo sapiens
gcccuccuuucuucuucuguc

SEQ ID NO: 42208 - RNA, 16 nt, Homo sapiens
ggaucaacugcagaau

SEQ ID NO: 42209 - RNA, 22 nt, Homo sapiens
gggagccccagccgucgggcgc

SEQ ID NO: 42210 - RNA, 28 nt, Homo sapiens
uaauauauauauauauaacuguauauau

SEQ ID NO: 42211 - RNA, 30 nt, Homo sapiens
uauauauauauauaacuguauauauauaua

SEQ ID NO: 42212 - RNA, 23 nt, Homo sapiens
uauauauauauuuauauaauaua

SEQ ID NO: 42213 - RNA, 25 nt, Homo sapiens
uauauauauauuuauauaauauaga

SEQ ID NO: 42214 - RNA, 19 nt, Homo sapiens
uccauaaaaugauauaauu

SEQ ID NO: 42215 - RNA, 21 nt, Homo sapiens
ucccaggcagggcaggggcag

SEQ ID NO: 42216 - RNA, 19 nt, Homo sapiens
ucccugccaagacuucccc

SEQ ID NO: 42217 - RNA, 18 nt, Homo sapiens
ucuuugguauaaaaauca

SEQ ID NO: 42218 - RNA, 22 nt, Homo sapiens
ugaggaugaugauguaggacca

SEQ ID NO: 42219 - RNA, 16 nt, Homo sapiens
ugauaugugugugugu

SEQ ID NO: 42220 - RNA, 17 nt, Homo sapiens
ugccagccuccuuuucc

SEQ ID NO: 42221 - RNA, 23 nt, Homo sapiens
ugcuuacugaagaagggagcaga

SEQ ID NO: 42222 - RNA, 24 nt, Homo sapiens
uguaaacuguguggccaaaaggga

SEQ ID NO: 42223 - RNA, 20 nt, Homo sapiens
ugugccauugcacucuugcc

SEQ ID NO: 42224 - RNA, 18 nt, Homo sapiens
uugggagguugagguggg

SEQ ID NO: 42225 - RNA, 20 nt, Homo sapiens
uuucuuguuuuugguuccac

SEQ ID NO: 42226 - RNA, 15 nt, Homo sapiens
gaaaguaugauuugg

SEQ ID NO: 42227 - RNA, 20 nt, Homo sapiens
gugugucuguggaaugaagg

SEQ ID NO: 42228 - RNA, 21 nt, Homo sapiens
ugagccaagagaaucuguugu

SEQ ID NO: 42229 - RNA, 20 nt, Homo sapiens
ugugugucuguggaaugaag

SEQ ID NO: 42230 - RNA, 17 nt, Homo sapiens
acaguguacuugaagga

SEQ ID NO: 42231 - RNA, 14 nt, Homo sapiens
agcaaaguccuggu

SEQ ID NO: 42232 - RNA, 17 nt, Homo sapiens
agcauuuuccuuaugga

SEQ ID NO: 42233 - RNA, 23 nt, Homo sapiens
agggagucagcccgcccagcccc

SEQ ID NO: 42234 - RNA, 19 nt, Homo sapiens
caacaucagucuuucccag

SEQ ID NO: 42235 - RNA, 18 nt, Homo sapiens
caguauggcucuuuucug

SEQ ID NO: 42236 - RNA, 20 nt, Homo sapiens
caucucagcaggcuguacaa

SEQ ID NO: 42237 - RNA, 19 nt, Homo sapiens
ccuaugcacuauggggccu

SEQ ID NO: 42238 - RNA, 18 nt, Homo sapiens
cugggguagggaccuugu

SEQ ID NO: 42239 - RNA, 19 nt, Homo sapiens
gaacaggggcccugcaggg

SEQ ID NO: 42240 - RNA, 15 nt, Homo sapiens
gaggaaacaaguugg

SEQ ID NO: 42241 - RNA, 23 nt, Homo sapiens
gcagggcuuucugguaggaggac

SEQ ID NO: 42242 - RNA, 18 nt, Homo sapiens
ggaggcagcagcuuggag

SEQ ID NO: 42243 - RNA, 21 nt, Homo sapiens
gggucagggcagaggggucug

SEQ ID NO: 42244 - RNA, 16 nt, Homo sapiens
uaacuguagaagcucu

SEQ ID NO: 42245 - RNA, 21 nt, Homo sapiens
uacuguuccuaugcacuaugg

SEQ ID NO: 42246 - RNA, 18 nt, Homo sapiens
uagcaguugcagugggcu

SEQ ID NO: 42247 - RNA, 17 nt, Homo sapiens
ucaauaucacuucgaga

SEQ ID NO: 42248 - RNA, 17 nt, Homo sapiens
ucccagugagguggugg

SEQ ID NO: 42249 - RNA, 16 nt, Homo sapiens
ucgccgcagguccggg

SEQ ID NO: 42250 - RNA, 21 nt, Homo sapiens
uggcacucccagagcuuugcc

SEQ ID NO: 42251 - RNA, 18 nt, Homo sapiens
uguagaagcucuagaugu

SEQ ID NO: 42252 - RNA, 25 nt, Homo sapiens
uguuucuaauccuguuuuucugcaa

SEQ ID NO: 42253 - RNA, 17 nt, Homo sapiens
aagggcucaguccacag

SEQ ID NO: 42254 - RNA, 15 nt, Homo sapiens
ccucugggggagggg

SEQ ID NO: 42255 - RNA, 19 nt, Homo sapiens
gccagagggugaggcccac

SEQ ID NO: 42256 - RNA, 18 nt, Homo sapiens
ggcugagacugccggugc

SEQ ID NO: 42257 - RNA, 14 nt, Homo sapiens
ggggaggggcaagg

SEQ ID NO: 42258 - RNA, 20 nt, Homo sapiens
aacaggggccuagguauguu

SEQ ID NO: 42259 - RNA, 15 nt, Homo sapiens
gaagguuuuaauucc

SEQ ID NO: 42260 - RNA, 17 nt, Homo sapiens
ucuaugcacacguucag

SEQ ID NO: 42261 - RNA, 17 nt, Homo sapiens
cagccgccgccgccccc

SEQ ID NO: 42262 - RNA, 16 nt, Homo sapiens
ccccgcaccgggcucg

SEQ ID NO: 42263 - RNA, 19 nt, Homo sapiens
cccgcccgcccgcccggcc

SEQ ID NO: 42264 - RNA, 15 nt, Homo sapiens
cccgccgccccggcc

SEQ ID NO: 42265 - RNA, 19 nt, Homo sapiens
ccgccgccccggccucccg

SEQ ID NO: 42266 - RNA, 21 nt, Homo sapiens
ccgccgccgcccccgaagucg

SEQ ID NO: 42267 - RNA, 24 nt, Homo sapiens
ccgccgcgcgccuccagcuccucc

SEQ ID NO: 42268 - RNA, 19 nt, Homo sapiens
ccugcccccgucgccgcgc

SEQ ID NO: 42269 - RNA, 17 nt, Homo sapiens
cgaugugcgacgacucg

SEQ ID NO: 42270 - RNA, 14 nt, Homo sapiens
cucccggccuccgu

SEQ ID NO: 42271 - RNA, 16 nt, Homo sapiens
cucccggccuccgucc

SEQ ID NO: 42272 - RNA, 16 nt, Homo sapiens
gcagucgagcagcagc

SEQ ID NO: 42273 - RNA, 19 nt, Homo sapiens
gccgagcugcgcgcccgcc

SEQ ID NO: 42274 - RNA, 19 nt, Homo sapiens
ggcccggggccggggccgg

SEQ ID NO: 42275 - RNA, 23 nt, Homo sapiens
ggcgcccgccucccgccgagcug

SEQ ID NO: 42276 - RNA, 21 nt, Homo sapiens
gggccgggcagcccugcccug

SEQ ID NO: 42277 - RNA, 21 nt, Homo sapiens
ucgaagagcucgugcggccgg

SEQ ID NO: 42278 - RNA, 15 nt, Homo sapiens
uggacgcccaaagcc

SEQ ID NO: 42279 - RNA, 20 nt, Homo sapiens
gcggggcggggacgggggcu

SEQ ID NO: 42280 - RNA, 21 nt, Homo sapiens
gggggcucggggccucaauac

SEQ ID NO: 42281 - RNA, 15 nt, Homo sapiens
ugacucugcaguggc

SEQ ID NO: 42282 - RNA, 17 nt, Homo sapiens
ugcaguggcucuggcaa

SEQ ID NO: 42283 - RNA, 19 nt, Homo sapiens
uggcaaggguggaaugugc

SEQ ID NO: 42284 - RNA, 24 nt, Homo sapiens
acaggcacauauuaaaaugaguau

SEQ ID NO: 42285 - RNA, 18 nt, Homo sapiens
ccaaccuuccccuccccc

SEQ ID NO: 42286 - RNA, 23 nt, Homo sapiens
cugucccgaggcaaaagagaggg

SEQ ID NO: 42287 - RNA, 18 nt, Homo sapiens
ggagugaaagcuuggcgg

SEQ ID NO: 42288 - RNA, 26 nt, Homo sapiens
uacgauaaaugcucaguuuccagugc

SEQ ID NO: 42289 - RNA, 17 nt, Homo sapiens
uccugcugggcuuugca

SEQ ID NO: 42290 - RNA, 17 nt, Homo sapiens
ucuuccccucccacccc

SEQ ID NO: 42291 - RNA, 15 nt, Homo sapiens
ggaggucuucucugc

SEQ ID NO: 42292 - RNA, 24 nt, Homo sapiens
cauuuugcaaauaauuugucuccc

SEQ ID NO: 42293 - RNA, 21 nt, Homo sapiens
gaagauuacaccaagaaaaca

SEQ ID NO: 42294 - RNA, 19 nt, Homo sapiens
gagagggagaggaaacccu

SEQ ID NO: 42295 - RNA, 17 nt, Homo sapiens
gcgguggggggcggggg

SEQ ID NO: 42296 - RNA, 18 nt, Homo sapiens
ggcgguggggggcggggg

SEQ ID NO: 42297 - RNA, 17 nt, Homo sapiens
gguggggcggugggggg

SEQ ID NO: 42298 - RNA, 20 nt, Homo sapiens
gguggggcgguggggggcgg

SEQ ID NO: 42299 - RNA, 15 nt, Homo sapiens
guggggcgguggggg

SEQ ID NO: 42300 - RNA, 18 nt, Homo sapiens
uaaaauauaucaaauugu

SEQ ID NO: 42301 - RNA, 20 nt, Homo sapiens
uauauauauauuuauacaua

SEQ ID NO: 42302 - RNA, 18 nt, Homo sapiens
ucguguggcccugucagc

SEQ ID NO: 42303 - RNA, 15 nt, Homo sapiens
ugggaaggugagaua

SEQ ID NO: 42304 - RNA, 16 nt, Homo sapiens
ugguggggcggugggg

SEQ ID NO: 42305 - RNA, 21 nt, Homo sapiens
acgugccaagcagcucaaagg

SEQ ID NO: 42306 - RNA, 23 nt, Homo sapiens
auuauggcaauaaaaauguggcu

SEQ ID NO: 42307 - RNA, 19 nt, Homo sapiens
caccucgggagaaggcucc

SEQ ID NO: 42308 - RNA, 16 nt, Homo sapiens
gcaacuguuguccccc

SEQ ID NO: 42309 - RNA, 17 nt, Homo sapiens
ucuagagacaccaggcc

SEQ ID NO: 42310 - RNA, 15 nt, Homo sapiens
agggaggguggggua

SEQ ID NO: 42311 - RNA, 17 nt, Homo sapiens
gcccugccuggggcucc

SEQ ID NO: 42312 - RNA, 16 nt, Homo sapiens
gccggagccgggcugc

SEQ ID NO: 42313 - RNA, 17 nt, Homo sapiens
ggcagaggcgggcggcc

SEQ ID NO: 42314 - RNA, 16 nt, Homo sapiens
ggcgccucagccgggc

SEQ ID NO: 42315 - RNA, 18 nt, Homo sapiens
gggcuggggcggggccgg

SEQ ID NO: 42316 - RNA, 21 nt, Homo sapiens
acggguccuggccugggcaug

SEQ ID NO: 42317 - RNA, 19 nt, Homo sapiens
cucgauaugaggacaccau

SEQ ID NO: 42318 - RNA, 21 nt, Homo sapiens
ggacuuuguccgucuccgccu

SEQ ID NO: 42319 - RNA, 21 nt, Homo sapiens
ugcuuuuggaugagguugggg

SEQ ID NO: 42320 - RNA, 16 nt, Homo sapiens
uuuuaucaccagaguu

SEQ ID NO: 42321 - RNA, 20 nt, Homo sapiens
agcauuacuaacaagcuaau

SEQ ID NO: 42322 - RNA, 21 nt, Homo sapiens
agccccgaggggugggggcgg

SEQ ID NO: 42323 - RNA, 20 nt, Homo sapiens
ucuaguaucaguguuguauu

SEQ ID NO: 42324 - RNA, 22 nt, Homo sapiens
ugggggcggccggccugggcag

SEQ ID NO: 42325 - RNA, 19 nt, Homo sapiens
cauggguacagagcaaacc

SEQ ID NO: 42326 - RNA, 19 nt, Homo sapiens
cccagcugcagccgcuggc

SEQ ID NO: 42327 - RNA, 24 nt, Homo sapiens
ccuacccuaucauuugguucuacc

SEQ ID NO: 42328 - RNA, 22 nt, Homo sapiens
uaucagauuuuuuuuuccaaac

SEQ ID NO: 42329 - RNA, 16 nt, Homo sapiens
ucccucccuccaaggc

SEQ ID NO: 42330 - RNA, 21 nt, Homo sapiens
uuagaaaagagcacaauuuuc

SEQ ID NO: 42331 - RNA, 21 nt, Homo sapiens
agggauuccuccaaagccuca

SEQ ID NO: 42332 - RNA, 19 nt, Homo sapiens
agugaaagaggucccgugg

SEQ ID NO: 42333 - RNA, 19 nt, Homo sapiens
caaccugcaaugcaggguu

SEQ ID NO: 42334 - RNA, 22 nt, Homo sapiens
caggacuggugcaggcuccuga

SEQ ID NO: 42335 - RNA, 17 nt, Homo sapiens
ccagaggggccgcccug

SEQ ID NO: 42336 - RNA, 20 nt, Homo sapiens
gaagcccggucaggccaggc

SEQ ID NO: 42337 - RNA, 18 nt, Homo sapiens
gaucccagggaaguaagg

SEQ ID NO: 42338 - RNA, 18 nt, Homo sapiens
gcagggcgagcacaggcu

SEQ ID NO: 42339 - RNA, 20 nt, Homo sapiens
gcccucuuugucccuuuugc

SEQ ID NO: 42340 - RNA, 17 nt, Homo sapiens
gugaucuggaaucuccc

SEQ ID NO: 42341 - RNA, 16 nt, Homo sapiens
gugggcacaguuccag

SEQ ID NO: 42342 - RNA, 21 nt, Homo sapiens
uccuugcugcugauggcuucu

SEQ ID NO: 42343 - RNA, 23 nt, Homo sapiens
ugagggguagcuggcugaacaga

SEQ ID NO: 42344 - RNA, 20 nt, Homo sapiens
ugggggcuuuccaggacacc

SEQ ID NO: 42345 - RNA, 22 nt, Homo sapiens
uggugugggcacaguuccaggc

SEQ ID NO: 42346 - RNA, 19 nt, Homo sapiens
ugugaugugugaucuggaa

SEQ ID NO: 42347 - RNA, 19 nt, Homo sapiens
uuuugcccaggauaccccc

SEQ ID NO: 42348 - RNA, 19 nt, Homo sapiens
aaucauuguugguucaacc

SEQ ID NO: 42349 - RNA, 22 nt, Homo sapiens
aggcugaagcccaggccugggc

SEQ ID NO: 42350 - RNA, 18 nt, Homo sapiens
auauauauauauauauau

SEQ ID NO: 42351 - RNA, 16 nt, Homo sapiens
auggcuuuauacaagu

SEQ ID NO: 42352 - RNA, 19 nt, Homo sapiens
cccaccgccugccucuagc

SEQ ID NO: 42353 - RNA, 18 nt, Homo sapiens
cccgcaggaguccucggg

SEQ ID NO: 42354 - RNA, 20 nt, Homo sapiens
ccgcggcccggaccgccccg

SEQ ID NO: 42355 - RNA, 21 nt, Homo sapiens
ccggcuucgggucuccaaggc

SEQ ID NO: 42356 - RNA, 18 nt, Homo sapiens
cgggcccaccgccugccu

SEQ ID NO: 42357 - RNA, 19 nt, Homo sapiens
gcaguauaaaacacacacu

SEQ ID NO: 42358 - RNA, 18 nt, Homo sapiens
gccgcggcccggaccgcc

SEQ ID NO: 42359 - RNA, 18 nt, Homo sapiens
uacacaguauaaugguca

SEQ ID NO: 42360 - RNA, 21 nt, Homo sapiens
uauauauauauacacaguaua

SEQ ID NO: 42361 - RNA, 18 nt, Homo sapiens
uauauauauauauauaua

SEQ ID NO: 42362 - RNA, 19 nt, Homo sapiens
uauauauauauauauauau

SEQ ID NO: 42363 - RNA, 21 nt, Homo sapiens
uauauauauauauauauauaa

SEQ ID NO: 42364 - RNA, 23 nt, Homo sapiens
uauauauauauauauauauguaa

SEQ ID NO: 42365 - RNA, 19 nt, Homo sapiens
ucacagacuaauacugagg

SEQ ID NO: 42366 - RNA, 19 nt, Homo sapiens
uguauguaucagucucuca

SEQ ID NO: 42367 - RNA, 17 nt, Homo sapiens
agaauaaauauaucccc

SEQ ID NO: 42368 - RNA, 19 nt, Homo sapiens
ccucuuaaaaaggccugag

SEQ ID NO: 42369 - RNA, 21 nt, Homo sapiens
uagcagaauccaaccucuuca

SEQ ID NO: 42370 - RNA, 23 nt, Homo sapiens
uuuaggcaauuuugguuacauuu

SEQ ID NO: 42371 - RNA, 22 nt, Homo sapiens
uuuuuccuuuuuuucuuuuuuu

SEQ ID NO: 42372 - RNA, 15 nt, Homo sapiens
acagaugaagcuccu

SEQ ID NO: 42373 - RNA, 18 nt, Homo sapiens
acaucaggaagaaaacag

SEQ ID NO: 42374 - RNA, 19 nt, Homo sapiens
acauuuuuggcaccaggga

SEQ ID NO: 42375 - RNA, 21 nt, Homo sapiens
caacauuuuuggcaccaggga

SEQ ID NO: 42376 - RNA, 22 nt, Homo sapiens
cacucuuguaacacauugauac

SEQ ID NO: 42377 - RNA, 17 nt, Homo sapiens
cagaguucacaauagga

SEQ ID NO: 42378 - RNA, 16 nt, Homo sapiens
ccagcuacaacauaau

SEQ ID NO: 42379 - RNA, 17 nt, Homo sapiens
cccgaggcggcggcgag

SEQ ID NO: 42380 - RNA, 19 nt, Homo sapiens
gauugcaauucauuuucuc

SEQ ID NO: 42381 - RNA, 17 nt, Homo sapiens
gcagggcagaggugcca

SEQ ID NO: 42382 - RNA, 18 nt, Homo sapiens
guggauaaagauaggcug

SEQ ID NO: 42383 - RNA, 24 nt, Homo sapiens
uagaauguugcucgggguacacag

SEQ ID NO: 42384 - RNA, 15 nt, Homo sapiens
uagccccuggccgug

SEQ ID NO: 42385 - RNA, 18 nt, Homo sapiens
ugcucaucaaaucuccau

SEQ ID NO: 42386 - RNA, 20 nt, Homo sapiens
ugucugagaguugaccuucc

SEQ ID NO: 42387 - RNA, 18 nt, Homo sapiens
uuuccauuguauccucua

SEQ ID NO: 42388 - RNA, 21 nt, Homo sapiens
uuugaugauugcaauucauuu

SEQ ID NO: 42389 - RNA, 19 nt, Homo sapiens
uuuuuccuagacuacuaua

SEQ ID NO: 42390 - RNA, 22 nt, Homo sapiens
agccucacgguccggcagcccc

SEQ ID NO: 42391 - RNA, 19 nt, Homo sapiens
agccuggucccaccccucc

SEQ ID NO: 42392 - RNA, 19 nt, Homo sapiens
agggagccccacgcuggcc

SEQ ID NO: 42393 - RNA, 23 nt, Homo sapiens
cagcgcccgggccgcuaugucuc

SEQ ID NO: 42394 - RNA, 17 nt, Homo sapiens
ccaacagaacacuucag

SEQ ID NO: 42395 - RNA, 18 nt, Homo sapiens
ccacgcagcuggagggcc

SEQ ID NO: 42396 - RNA, 20 nt, Homo sapiens
ccccucccugagggcccugg

SEQ ID NO: 42397 - RNA, 23 nt, Homo sapiens
ccgccgcccgcuuuuguccggcu

SEQ ID NO: 42398 - RNA, 22 nt, Homo sapiens
ccugaggaguaaugggcgacau

SEQ ID NO: 42399 - RNA, 17 nt, Homo sapiens
ccuggcugcaccccaaa

SEQ ID NO: 42400 - RNA, 19 nt, Homo sapiens
cugcagauuccagcuggaa

SEQ ID NO: 42401 - RNA, 17 nt, Homo sapiens
gcacgggcugugugccu

SEQ ID NO: 42402 - RNA, 21 nt, Homo sapiens
gcugggguggggggagcagga

SEQ ID NO: 42403 - RNA, 16 nt, Homo sapiens
gggcaccagguggagg

SEQ ID NO: 42404 - RNA, 19 nt, Homo sapiens
gguccccucccugagggcc

SEQ ID NO: 42405 - RNA, 18 nt, Homo sapiens
gguggggggagcaggagg

SEQ ID NO: 42406 - RNA, 23 nt, Homo sapiens
uaugucucaccucacuccccaga

SEQ ID NO: 42407 - RNA, 20 nt, Homo sapiens
ucagggcaguugcagaggcc

SEQ ID NO: 42408 - RNA, 18 nt, Homo sapiens
cagccgcagccuccggac

SEQ ID NO: 42409 - RNA, 19 nt, Homo sapiens
uucaugugauuucuguaca

SEQ ID NO: 42410 - RNA, 18 nt, Homo sapiens
aggaugguuacugggggu

SEQ ID NO: 42411 - RNA, 18 nt, Homo sapiens
cacccauccccacccccc

SEQ ID NO: 42412 - RNA, 17 nt, Homo sapiens
cgagggucccccaggga

SEQ ID NO: 42413 - RNA, 14 nt, Homo sapiens
gaggaaccggggag

SEQ ID NO: 42414 - RNA, 21 nt, Homo sapiens
gagggcuggggggaagggcug

SEQ ID NO: 42415 - RNA, 19 nt, Homo sapiens
gccccgggcgggcgguggg

SEQ ID NO: 42416 - RNA, 21 nt, Homo sapiens
ggaagggagacuuugggggca

SEQ ID NO: 42417 - RNA, 18 nt, Homo sapiens
gggcuggcaguggugggc

SEQ ID NO: 42418 - RNA, 21 nt, Homo sapiens
gggcuggggggaagggcuggg

SEQ ID NO: 42419 - RNA, 22 nt, Homo sapiens
uaggggaagggagacuuugggg

SEQ ID NO: 42420 - RNA, 16 nt, Homo sapiens
uccuccccgccggggc

SEQ ID NO: 42421 - RNA, 19 nt, Homo sapiens
aagcgaaagagcggggcgg

SEQ ID NO: 42422 - RNA, 21 nt, Homo sapiens
auggaggguucugcccagagg

SEQ ID NO: 42423 - RNA, 22 nt, Homo sapiens
cagccaugguggcaugcaccug

SEQ ID NO: 42424 - RNA, 19 nt, Homo sapiens
ccggggaagccacugcccc

SEQ ID NO: 42425 - RNA, 22 nt, Homo sapiens
gagguugcagugagccaagauc

SEQ ID NO: 42426 - RNA, 19 nt, Homo sapiens
gccccggguggggugaggg

SEQ ID NO: 42427 - RNA, 21 nt, Homo sapiens
gccuuccuucuuccucugcca

SEQ ID NO: 42428 - RNA, 19 nt, Homo sapiens
ggaguggggugggaguggg

SEQ ID NO: 42429 - RNA, 19 nt, Homo sapiens
ggccccuccuggcuggggc

SEQ ID NO: 42430 - RNA, 19 nt, Homo sapiens
ggcggcggcugccggcggc

SEQ ID NO: 42431 - RNA, 19 nt, Homo sapiens
gggaaaacaggcagggaga

SEQ ID NO: 42432 - RNA, 20 nt, Homo sapiens
gggcaguccgggguauggcc

SEQ ID NO: 42433 - RNA, 15 nt, Homo sapiens
ggggugagggggugg

SEQ ID NO: 42434 - RNA, 22 nt, Homo sapiens
gggguggggagagaacuggggg

SEQ ID NO: 42435 - RNA, 20 nt, Homo sapiens
gguucugcccagaggcucca

SEQ ID NO: 42436 - RNA, 20 nt, Homo sapiens
guggaggaugggacagugcu

SEQ ID NO: 42437 - RNA, 22 nt, Homo sapiens
uccacuuuggggaaaacaggca

SEQ ID NO: 42438 - RNA, 20 nt, Homo sapiens
ugaggggcaagaggggcggc

SEQ ID NO: 42439 - RNA, 16 nt, Homo sapiens
uggcucccgcaguccu

SEQ ID NO: 42440 - RNA, 21 nt, Homo sapiens
aaaggaaagggaaaaaggaaa

SEQ ID NO: 42441 - RNA, 20 nt, Homo sapiens
aaaggaaagggaaaaggaaa

SEQ ID NO: 42442 - RNA, 18 nt, Homo sapiens
acacaaauguucuccuag

SEQ ID NO: 42443 - RNA, 19 nt, Homo sapiens
agggaggugaaagaagaaa

SEQ ID NO: 42444 - RNA, 21 nt, Homo sapiens
ccaacacccauuuucucuucu

SEQ ID NO: 42445 - RNA, 19 nt, Homo sapiens
cccugaaaaaguuacauag

SEQ ID NO: 42446 - RNA, 20 nt, Homo sapiens
ggaaaggaaagggggaaggg

SEQ ID NO: 42447 - RNA, 21 nt, Homo sapiens
uaauucuggcauuugccuuau

SEQ ID NO: 42448 - RNA, 16 nt, Homo sapiens
uagaaaaaaggggaag

SEQ ID NO: 42449 - RNA, 16 nt, Homo sapiens
ugagaagacuucccuc

SEQ ID NO: 42450 - RNA, 21 nt, Homo sapiens
uuaauaaauggcugaaaagug

SEQ ID NO: 42451 - RNA, 20 nt, Homo sapiens
aaaaaaugcauaggguugag

SEQ ID NO: 42452 - RNA, 22 nt, Homo sapiens
ccaggaagguuauucauauaag

SEQ ID NO: 42453 - RNA, 21 nt, Homo sapiens
ccugccaugguccaucuucau

SEQ ID NO: 42454 - RNA, 19 nt, Homo sapiens
uccggggagggggccagcg

SEQ ID NO: 42455 - RNA, 18 nt, Homo sapiens
cgggcggcggcggcggcg

SEQ ID NO: 42456 - RNA, 21 nt, Homo sapiens
gccgggcggcggcggcggcgg

SEQ ID NO: 42457 - RNA, 16 nt, Homo sapiens
acggagugcagcgcgu

SEQ ID NO: 42458 - RNA, 18 nt, Homo sapiens
gcucauaaaagaccauca

SEQ ID NO: 42459 - RNA, 17 nt, Homo sapiens
ugguaacuggcaaggga

SEQ ID NO: 42460 - RNA, 19 nt, Homo sapiens
uuccuaauuaccaaaagca

SEQ ID NO: 42461 - RNA, 20 nt, Homo sapiens
gcaaaggguugaauuggucg

SEQ ID NO: 42462 - RNA, 18 nt, Homo sapiens
acaaugagagugagcagg

SEQ ID NO: 42463 - RNA, 23 nt, Homo sapiens
accaacucugagcgccgccgcag

SEQ ID NO: 42464 - RNA, 21 nt, Homo sapiens
agaggggucagggagcagccu

SEQ ID NO: 42465 - RNA, 18 nt, Homo sapiens
aggagagagggcaggcag

SEQ ID NO: 42466 - RNA, 16 nt, Homo sapiens
aggccagacaaugaga

SEQ ID NO: 42467 - RNA, 19 nt, Homo sapiens
aggggucagggagcagccu

SEQ ID NO: 42468 - RNA, 15 nt, Homo sapiens
ccagagggcacgugu

SEQ ID NO: 42469 - RNA, 15 nt, Homo sapiens
cccgccgccccaacc

SEQ ID NO: 42470 - RNA, 21 nt, Homo sapiens
ccgaccggccgccgccucccc

SEQ ID NO: 42471 - RNA, 21 nt, Homo sapiens
ccugaagaaguggugguccca

SEQ ID NO: 42472 - RNA, 21 nt, Homo sapiens
cgggcugggcugggccgggcc

SEQ ID NO: 42473 - RNA, 25 nt, Homo sapiens
ggccgagccggugcgcggcgccgcc

SEQ ID NO: 42474 - RNA, 22 nt, Homo sapiens
gggaggggaagacagcaggaag

SEQ ID NO: 42475 - RNA, 18 nt, Homo sapiens
gugacucccccucucuca

SEQ ID NO: 42476 - RNA, 18 nt, Homo sapiens
ucugagcgccgccgcagc

SEQ ID NO: 42477 - RNA, 15 nt, Homo sapiens
uggccgagccggugc

SEQ ID NO: 42478 - RNA, 18 nt, Homo sapiens
acuagucauucagauugu

SEQ ID NO: 42479 - RNA, 23 nt, Homo sapiens
agucacgucuucaacaauuuuuu

SEQ ID NO: 42480 - RNA, 18 nt, Homo sapiens
cacgucuucaacaauuuu

SEQ ID NO: 42481 - RNA, 23 nt, Homo sapiens
gauuguuucaauauauacaguau

SEQ ID NO: 42482 - RNA, 19 nt, Homo sapiens
gauuuuguuuaauauuugg

SEQ ID NO: 42483 - RNA, 21 nt, Homo sapiens
uaaauuccuuugguuuaucaa

SEQ ID NO: 42484 - RNA, 18 nt, Homo sapiens
uagugcuuuauggugaua

SEQ ID NO: 42485 - RNA, 20 nt, Homo sapiens
uauacaguauaugcggaccu

SEQ ID NO: 42486 - RNA, 20 nt, Homo sapiens
uaucaaaagucugaaguaug

SEQ ID NO: 42487 - RNA, 21 nt, Homo sapiens
ucucauggagauauauugcua

SEQ ID NO: 42488 - RNA, 22 nt, Homo sapiens
uguaaaauagugcuuuauggug

SEQ ID NO: 42489 - RNA, 23 nt, Homo sapiens
aagcugcaggauuccaugaguga

SEQ ID NO: 42490 - RNA, 17 nt, Homo sapiens
gucuucuuucguaagaa

SEQ ID NO: 42491 - RNA, 14 nt, Homo sapiens
cccugacccucccc

SEQ ID NO: 42492 - RNA, 17 nt, Homo sapiens
gggcgguugugggggug

SEQ ID NO: 42493 - RNA, 18 nt, Homo sapiens
ggggaggacugagagggg

SEQ ID NO: 42494 - RNA, 22 nt, Homo sapiens
uggaggguggagaugaugcugc

SEQ ID NO: 42495 - RNA, 17 nt, Homo sapiens
uguggggguuggggagg

SEQ ID NO: 42496 - RNA, 20 nt, Homo sapiens
agggaggggcaaggccaagg

SEQ ID NO: 42497 - RNA, 24 nt, Homo sapiens
gcgcggggugccacacacaggccg

SEQ ID NO: 42498 - RNA, 23 nt, Homo sapiens
ggccggggggcuccgcagaggag

SEQ ID NO: 42499 - RNA, 19 nt, Homo sapiens
ggcgcccucccgaaagggg

SEQ ID NO: 42500 - RNA, 17 nt, Homo sapiens
agggggggagguggcac

SEQ ID NO: 42501 - RNA, 21 nt, Homo sapiens
agugagcagagauggggccac

SEQ ID NO: 42502 - RNA, 15 nt, Homo sapiens
cgggauaguucuggc

SEQ ID NO: 42503 - RNA, 18 nt, Homo sapiens
cgugguggugggcgccug

SEQ ID NO: 42504 - RNA, 19 nt, Homo sapiens
gcgcccggcugcaggcgcc

SEQ ID NO: 42505 - RNA, 17 nt, Homo sapiens
ggagggggggagguggc

SEQ ID NO: 42506 - RNA, 22 nt, Homo sapiens
ggagggggggagguggcacagg

SEQ ID NO: 42507 - RNA, 19 nt, Homo sapiens
gggccccaccuguccucuu

SEQ ID NO: 42508 - RNA, 18 nt, Homo sapiens
gggggggagguggcacag

SEQ ID NO: 42509 - RNA, 19 nt, Homo sapiens
uagcugggcgugguggugg

SEQ ID NO: 42510 - RNA, 19 nt, Homo sapiens
ucccaggcccacacccugg

SEQ ID NO: 42511 - RNA, 23 nt, Homo sapiens
ugagggggaaggauggugugugg

SEQ ID NO: 42512 - RNA, 22 nt, Homo sapiens
agaccagggaaucacuuucagg

SEQ ID NO: 42513 - RNA, 23 nt, Homo sapiens
auuuaucuagcuauaaaaauaag

SEQ ID NO: 42514 - RNA, 16 nt, Homo sapiens
cacuggauagacacag

SEQ ID NO: 42515 - RNA, 18 nt, Homo sapiens
gacguaaaauagggcugg

SEQ ID NO: 42516 - RNA, 19 nt, Homo sapiens
gaggcgcgcgcgagguggc

SEQ ID NO: 42517 - RNA, 19 nt, Homo sapiens
gcgcgagguggcugacugc

SEQ ID NO: 42518 - RNA, 18 nt, Homo sapiens
ggauccuuaaggcuuucg

SEQ ID NO: 42519 - RNA, 15 nt, Homo sapiens
uaaacugacuuccuc

SEQ ID NO: 42520 - RNA, 24 nt, Homo sapiens
uaagaaacaauacagaauuaaaua

SEQ ID NO: 42521 - RNA, 18 nt, Homo sapiens
uauauauauauauaaaua

SEQ ID NO: 42522 - RNA, 19 nt, Homo sapiens
uauauauauauauaaauau

SEQ ID NO: 42523 - RNA, 19 nt, Homo sapiens
ucaacaucauuccacuagc

SEQ ID NO: 42524 - RNA, 19 nt, Homo sapiens
ucgcucccaccucuuuugc

SEQ ID NO: 42525 - RNA, 19 nt, Homo sapiens
ucucuguauucuuucuucu

SEQ ID NO: 42526 - RNA, 18 nt, Homo sapiens
ucuguauucuuucuucuc

SEQ ID NO: 42527 - RNA, 14 nt, Homo sapiens
uuucagggugcugu

SEQ ID NO: 42528 - RNA, 18 nt, Homo sapiens
acaggccuggaccuccuc

SEQ ID NO: 42529 - RNA, 20 nt, Homo sapiens
acugagauccagcauucaca

SEQ ID NO: 42530 - RNA, 19 nt, Homo sapiens
aggguguggcugcacggua

SEQ ID NO: 42531 - RNA, 16 nt, Homo sapiens
cacgggucccuguggg

SEQ ID NO: 42532 - RNA, 21 nt, Homo sapiens
ccaucacgaguguccaccacc

SEQ ID NO: 42533 - RNA, 19 nt, Homo sapiens
cccaccccuccccccuccc

SEQ ID NO: 42534 - RNA, 18 nt, Homo sapiens
cuuuccagacuaaaaaua

SEQ ID NO: 42535 - RNA, 21 nt, Homo sapiens
ggacagggggccccagaggag

SEQ ID NO: 42536 - RNA, 22 nt, Homo sapiens
ggcggggcggggcagggcaggg

SEQ ID NO: 42537 - RNA, 18 nt, Homo sapiens
ggguccuugagguccuca

SEQ ID NO: 42538 - RNA, 16 nt, Homo sapiens
guguggcugcacggua

SEQ ID NO: 42539 - RNA, 18 nt, Homo sapiens
uaaaacgcuguggugaag

SEQ ID NO: 42540 - RNA, 16 nt, Homo sapiens
ugcuguccuuuccauu

SEQ ID NO: 42541 - RNA, 16 nt, Homo sapiens
caaaguauuuuccagg

SEQ ID NO: 42542 - RNA, 19 nt, Homo sapiens
uacugcucucuaauguuua

SEQ ID NO: 42543 - RNA, 20 nt, Homo sapiens
uccauuucaucuucagcacu

SEQ ID NO: 42544 - RNA, 23 nt, Homo sapiens
uguaacaaaauugcagaaaccua

SEQ ID NO: 42545 - RNA, 23 nt, Homo sapiens
uuagucuggagugucagugauau

SEQ ID NO: 42546 - RNA, 19 nt, Homo sapiens
aaaaagcuuuucaaaaguc

SEQ ID NO: 42547 - RNA, 15 nt, Homo sapiens
aaugcugaugucaau

SEQ ID NO: 42548 - RNA, 19 nt, Homo sapiens
acaaaguuugccaauuguu

SEQ ID NO: 42549 - RNA, 15 nt, Homo sapiens
augugcaaaaggugc

SEQ ID NO: 42550 - RNA, 18 nt, Homo sapiens
gagugcgagggggugcgg

SEQ ID NO: 42551 - RNA, 18 nt, Homo sapiens
gcagugagccgagaucgu

SEQ ID NO: 42552 - RNA, 18 nt, Homo sapiens
ugcguuuccauguauucu

SEQ ID NO: 42553 - RNA, 17 nt, Homo sapiens
uugggaggccaaggugg

SEQ ID NO: 42554 - RNA, 20 nt, Homo sapiens
aggccaaagcugcuaguggg

SEQ ID NO: 42555 - RNA, 16 nt, Homo sapiens
gauggcccgggguuuc

SEQ ID NO: 42556 - RNA, 23 nt, Homo sapiens
gcugcuagugggauggcccgggg

SEQ ID NO: 42557 - RNA, 22 nt, Homo sapiens
uguguuuguuuucugcugcagu

SEQ ID NO: 42558 - RNA, 21 nt, Homo sapiens
aaaguuaccauuagaauuguc

SEQ ID NO: 42559 - RNA, 19 nt, Homo sapiens
cagggcaaaacgaagccuc

SEQ ID NO: 42560 - RNA, 15 nt, Homo sapiens
ccgcgcggcuggagc

SEQ ID NO: 42561 - RNA, 20 nt, Homo sapiens
ccggguccuccuccuucucc

SEQ ID NO: 42562 - RNA, 19 nt, Homo sapiens
ccucuggcucccucccucc

SEQ ID NO: 42563 - RNA, 19 nt, Homo sapiens
ccugccuacccuccuuccc

SEQ ID NO: 42564 - RNA, 16 nt, Homo sapiens
cggagcagaguaccgc

SEQ ID NO: 42565 - RNA, 20 nt, Homo sapiens
cuucuugcucugcugugguu

SEQ ID NO: 42566 - RNA, 16 nt, Homo sapiens
cuuuggguuugcugag

SEQ ID NO: 42567 - RNA, 17 nt, Homo sapiens
gccauuaaggauuuaaa

SEQ ID NO: 42568 - RNA, 17 nt, Homo sapiens
gcgcauaaaaguuuaaa

SEQ ID NO: 42569 - RNA, 20 nt, Homo sapiens
gcgccugcucccgccgcccg

SEQ ID NO: 42570 - RNA, 18 nt, Homo sapiens
gcuuuagaaagcuaggcu

SEQ ID NO: 42571 - RNA, 19 nt, Homo sapiens
guaauugagggacacagcg

SEQ ID NO: 42572 - RNA, 20 nt, Homo sapiens
gugauggggcaggaaucuga

SEQ ID NO: 42573 - RNA, 22 nt, Homo sapiens
guucaguuucugguuuuaagga

SEQ ID NO: 42574 - RNA, 16 nt, Homo sapiens
uaagcuucaguagaca

SEQ ID NO: 42575 - RNA, 22 nt, Homo sapiens
uaugucuauucauaagacuaca

SEQ ID NO: 42576 - RNA, 17 nt, Homo sapiens
ugccuacccuccuuccc

SEQ ID NO: 42577 - RNA, 18 nt, Homo sapiens
uguugguuucugcacucc

SEQ ID NO: 42578 - RNA, 21 nt, Homo sapiens
aaccggcugugggggagcagg

SEQ ID NO: 42579 - RNA, 18 nt, Homo sapiens
aaggcuacugucaaugca

SEQ ID NO: 42580 - RNA, 17 nt, Homo sapiens
aagggcacuggcuguua

SEQ ID NO: 42581 - RNA, 19 nt, Homo sapiens
aagucagucagucuugcaa

SEQ ID NO: 42582 - RNA, 23 nt, Homo sapiens
aaguuauauacuccaaguuugga

SEQ ID NO: 42583 - RNA, 20 nt, Homo sapiens
agaaaaaaaauuagaugaag

SEQ ID NO: 42584 - RNA, 17 nt, Homo sapiens
agcaauuugccuucagg

SEQ ID NO: 42585 - RNA, 18 nt, Homo sapiens
aggacgcuccgccuggcc

SEQ ID NO: 42586 - RNA, 20 nt, Homo sapiens
cagggggugggguagggucg

SEQ ID NO: 42587 - RNA, 21 nt, Homo sapiens
cccucugucacuccccucccg

SEQ ID NO: 42588 - RNA, 16 nt, Homo sapiens
cccuucuuacugcccu

SEQ ID NO: 42589 - RNA, 20 nt, Homo sapiens
ccucgggccggacgucaucg

SEQ ID NO: 42590 - RNA, 20 nt, Homo sapiens
cuuuagccuaacuugcaccu

SEQ ID NO: 42591 - RNA, 21 nt, Homo sapiens
gcagaaaagagagagcgccaa

SEQ ID NO: 42592 - RNA, 17 nt, Homo sapiens
gcaggaggggccuccuc

SEQ ID NO: 42593 - RNA, 16 nt, Homo sapiens
ggggugggguggggag

SEQ ID NO: 42594 - RNA, 19 nt, Homo sapiens
gugggggagcagggggaaa

SEQ ID NO: 42595 - RNA, 20 nt, Homo sapiens
uagaacgucccucugucacu

SEQ ID NO: 42596 - RNA, 16 nt, Homo sapiens
uauauacuccaaguuu

SEQ ID NO: 42597 - RNA, 18 nt, Homo sapiens
uauauacuccaaguuugg

SEQ ID NO: 42598 - RNA, 18 nt, Homo sapiens
ucccaguucccuucuucc

SEQ ID NO: 42599 - RNA, 20 nt, Homo sapiens
ucgccccuuccugccagccc

SEQ ID NO: 42600 - RNA, 18 nt, Homo sapiens
ucggcgggggccgcgcgc

SEQ ID NO: 42601 - RNA, 19 nt, Homo sapiens
ugcagaaaauacccaaauc

SEQ ID NO: 42602 - RNA, 17 nt, Homo sapiens
uggcugcaggcagucug

SEQ ID NO: 42603 - RNA, 20 nt, Homo sapiens
uggugagccaggaggagcac

SEQ ID NO: 42604 - RNA, 21 nt, Homo sapiens
uguagauuccagggcugccau

SEQ ID NO: 42605 - RNA, 22 nt, Homo sapiens
ugucaaugcagaaucuaauguu

SEQ ID NO: 42606 - RNA, 20 nt, Homo sapiens
uguccccauccuccccuucc

SEQ ID NO: 42607 - RNA, 20 nt, Homo sapiens
uuaccaccaucgagugucug

SEQ ID NO: 42608 - RNA, 18 nt, Homo sapiens
uucuggggcuauuuuuau

SEQ ID NO: 42609 - RNA, 18 nt, Homo sapiens
uugaacauuuguaguggc

SEQ ID NO: 42610 - RNA, 19 nt, Homo sapiens
uugcaccuggcaccacucu

SEQ ID NO: 42611 - RNA, 20 nt, Homo sapiens
auuucucuuuuuacaucuua

SEQ ID NO: 42612 - RNA, 17 nt, Homo sapiens
cauuuuccuccaaaaca

SEQ ID NO: 42613 - RNA, 19 nt, Homo sapiens
gaggaaagugacucuucaa

SEQ ID NO: 42614 - RNA, 22 nt, Homo sapiens
gugagaaacuauuccagaugag

SEQ ID NO: 42615 - RNA, 18 nt, Homo sapiens
uaaaacaaagagaacaga

SEQ ID NO: 42616 - RNA, 23 nt, Homo sapiens
uaauuauaauuucuguucucauu

SEQ ID NO: 42617 - RNA, 17 nt, Homo sapiens
uacaaugaaagugcagg

SEQ ID NO: 42618 - RNA, 18 nt, Homo sapiens
uuuacaaaauucucucuu

SEQ ID NO: 42619 - RNA, 15 nt, Homo sapiens
aacauacacaggcuu

SEQ ID NO: 42620 - RNA, 18 nt, Homo sapiens
cacccguccagggacaca

SEQ ID NO: 42621 - RNA, 17 nt, Homo sapiens
gaacccucggaguccuc

SEQ ID NO: 42622 - RNA, 20 nt, Homo sapiens
gccacuggucacgcugggca

SEQ ID NO: 42623 - RNA, 14 nt, Homo sapiens
ggaacucacaggaa

SEQ ID NO: 42624 - RNA, 20 nt, Homo sapiens
ggcuccacuguggggcugcu

SEQ ID NO: 42625 - RNA, 15 nt, Homo sapiens
uuucuggaguggacu

SEQ ID NO: 42626 - RNA, 21 nt, Homo sapiens
aaggugggccuggccuagaca

SEQ ID NO: 42627 - RNA, 20 nt, Homo sapiens
cauuucucuuccaccccagg

SEQ ID NO: 42628 - RNA, 23 nt, Homo sapiens
cccaggaaggggaggaugccucc

SEQ ID NO: 42629 - RNA, 19 nt, Homo sapiens
ccucaaaguucuggacacc

SEQ ID NO: 42630 - RNA, 19 nt, Homo sapiens
uccaccccagggugagggc

SEQ ID NO: 42631 - RNA, 16 nt, Homo sapiens
agggugugcugcugca

SEQ ID NO: 42632 - RNA, 15 nt, Homo sapiens
caacucguauaugcg

SEQ ID NO: 42633 - RNA, 18 nt, Homo sapiens
caucacaugugacaaaca

SEQ ID NO: 42634 - RNA, 20 nt, Homo sapiens
cauuccucgauugacccugu

SEQ ID NO: 42635 - RNA, 17 nt, Homo sapiens
ccccggucuugcccuuc

SEQ ID NO: 42636 - RNA, 20 nt, Homo sapiens
cgcagaggaguuaguuaagg

SEQ ID NO: 42637 - RNA, 20 nt, Homo sapiens
gaaaugugugguccaaauac

SEQ ID NO: 42638 - RNA, 20 nt, Homo sapiens
gauccaaacauaaaauugca

SEQ ID NO: 42639 - RNA, 23 nt, Homo sapiens
gccuggacccgguggcguccaga

SEQ ID NO: 42640 - RNA, 16 nt, Homo sapiens
ggcagaucuguuugcc

SEQ ID NO: 42641 - RNA, 18 nt, Homo sapiens
uaaggcccuuucgauagu

SEQ ID NO: 42642 - RNA, 16 nt, Homo sapiens
uggcugcuguuaggac

SEQ ID NO: 42643 - RNA, 18 nt, Homo sapiens
uguggauuuucuuucaca

SEQ ID NO: 42644 - RNA, 18 nt, Homo sapiens
aagcggcgggggaacagg

SEQ ID NO: 42645 - RNA, 22 nt, Homo sapiens
aagcuggggguccaggcuggag

SEQ ID NO: 42646 - RNA, 18 nt, Homo sapiens
cccccaucuuccucaggg

SEQ ID NO: 42647 - RNA, 18 nt, Homo sapiens
ccgagcggcugggguugg

SEQ ID NO: 42648 - RNA, 22 nt, Homo sapiens
ccgccguccgccggcccggccg

SEQ ID NO: 42649 - RNA, 17 nt, Homo sapiens
cggcccggccgccgccc

SEQ ID NO: 42650 - RNA, 14 nt, Homo sapiens
gcccaucccgccag

SEQ ID NO: 42651 - RNA, 14 nt, Homo sapiens
ggguccaggcugga

SEQ ID NO: 42652 - RNA, 16 nt, Homo sapiens
uccaggaaugguggcg

SEQ ID NO: 42653 - RNA, 18 nt, Homo sapiens
ucucagacaagggcaggc

SEQ ID NO: 42654 - RNA, 20 nt, Homo sapiens
agcccuggcucucuuggugg

SEQ ID NO: 42655 - RNA, 20 nt, Homo sapiens
aggggugagacuaaaggcgg

SEQ ID NO: 42656 - RNA, 14 nt, Homo sapiens
cacgaugugcugga

SEQ ID NO: 42657 - RNA, 18 nt, Homo sapiens
gcaugguggccacggugg

SEQ ID NO: 42658 - RNA, 18 nt, Homo sapiens
ggacaugauguacugccc

SEQ ID NO: 42659 - RNA, 19 nt, Homo sapiens
ucagauagucgaugucagu

SEQ ID NO: 42660 - RNA, 24 nt, Homo sapiens
ucaguaauucacacuccgcauggu

SEQ ID NO: 42661 - RNA, 21 nt, Homo sapiens
ucgaacuccuggcuucaugau

SEQ ID NO: 42662 - RNA, 18 nt, Homo sapiens
ugcccaaucuugggcaga

SEQ ID NO: 42663 - RNA, 16 nt, Homo sapiens
ugcgagagcaccgagg

SEQ ID NO: 42664 - RNA, 16 nt, Homo sapiens
uggugguccggugugu

SEQ ID NO: 42665 - RNA, 16 nt, Homo sapiens
uuggcagagugugggc

SEQ ID NO: 42666 - RNA, 18 nt, Homo sapiens
acgggaggggagggcggg

SEQ ID NO: 42667 - RNA, 20 nt, Homo sapiens
agaauuaguugccauucuac

SEQ ID NO: 42668 - RNA, 17 nt, Homo sapiens
cccuccgcucccggccc

SEQ ID NO: 42669 - RNA, 19 nt, Homo sapiens
ccgaggccccgaggccugg

SEQ ID NO: 42670 - RNA, 25 nt, Homo sapiens
ccuccucccccucugagcucucugu

SEQ ID NO: 42671 - RNA, 15 nt, Homo sapiens
cgcgagcagcccaag

SEQ ID NO: 42672 - RNA, 21 nt, Homo sapiens
cggcgccgccgccgccgcccg

SEQ ID NO: 42673 - RNA, 17 nt, Homo sapiens
cuuugcuccucccccag

SEQ ID NO: 42674 - RNA, 19 nt, Homo sapiens
cuuugcuccucccccagcu

SEQ ID NO: 42675 - RNA, 21 nt, Homo sapiens
gcccgcccgccggcccgcgcc

SEQ ID NO: 42676 - RNA, 23 nt, Homo sapiens
gcgccgccgccgccgcccgccga

SEQ ID NO: 42677 - RNA, 20 nt, Homo sapiens
gcggggcgggccucugcgcu

SEQ ID NO: 42678 - RNA, 22 nt, Homo sapiens
gcugcagccuccucccccucug

SEQ ID NO: 42679 - RNA, 22 nt, Homo sapiens
gcugccccuucgccccggcgcg

SEQ ID NO: 42680 - RNA, 18 nt, Homo sapiens
ggcugggcgugacgggag

SEQ ID NO: 42681 - RNA, 21 nt, Homo sapiens
gggaggggagggcggggcggg

SEQ ID NO: 42682 - RNA, 20 nt, Homo sapiens
uacuccgucugcucgggugg

SEQ ID NO: 42683 - RNA, 21 nt, Homo sapiens
uuguuauugaggauggggugg

SEQ ID NO: 42684 - RNA, 16 nt, Homo sapiens
aauacucucacuucgc

SEQ ID NO: 42685 - RNA, 19 nt, Homo sapiens
cacucugguucccauuccu

SEQ ID NO: 42686 - RNA, 18 nt, Homo sapiens
cgugguggcagggccugu

SEQ ID NO: 42687 - RNA, 20 nt, Homo sapiens
cuggagaccaggccucagca

SEQ ID NO: 42688 - RNA, 16 nt, Homo sapiens
gaacccaggaggcgga

SEQ ID NO: 42689 - RNA, 22 nt, Homo sapiens
gcaaggucuguggcggcagagg

SEQ ID NO: 42690 - RNA, 18 nt, Homo sapiens
ucagaaguuguuaugaug

SEQ ID NO: 42691 - RNA, 19 nt, Homo sapiens
ugcuuuggaaaugaacgag

SEQ ID NO: 42692 - RNA, 19 nt, Homo sapiens
cggcggcggcgcagacgcg

SEQ ID NO: 42693 - RNA, 18 nt, Homo sapiens
cggcggcggcgcagacgg

SEQ ID NO: 42694 - RNA, 16 nt, Homo sapiens
gcagcagcucccgggc

SEQ ID NO: 42695 - RNA, 14 nt, Homo sapiens
gugccgcccacccg

SEQ ID NO: 42696 - RNA, 21 nt, Homo sapiens
guggcggugggugggaggggg

SEQ ID NO: 42697 - RNA, 19 nt, Homo sapiens
uccacaaagggcaaggacc

SEQ ID NO: 42698 - RNA, 18 nt, Homo sapiens
acaguuucugcacuaguu

SEQ ID NO: 42699 - RNA, 17 nt, Homo sapiens
cccugguauuuaagaaa

SEQ ID NO: 42700 - RNA, 16 nt, Homo sapiens
ccgccaguccgcccgc

SEQ ID NO: 42701 - RNA, 19 nt, Homo sapiens
ccgcccgcucgcggccccc

SEQ ID NO: 42702 - RNA, 19 nt, Homo sapiens
ccgccgccaguccgcccgc

SEQ ID NO: 42703 - RNA, 20 nt, Homo sapiens
ccgccgccgccaguccgccc

SEQ ID NO: 42704 - RNA, 21 nt, Homo sapiens
cugcccgccucccgcagcagu

SEQ ID NO: 42705 - RNA, 19 nt, Homo sapiens
gcgccgccaccgacucggu

SEQ ID NO: 42706 - RNA, 17 nt, Homo sapiens
gcucggcggcgggcgcc

SEQ ID NO: 42707 - RNA, 21 nt, Homo sapiens
aagggauuaaauccuuucuuc

SEQ ID NO: 42708 - RNA, 24 nt, Homo sapiens
acagaauaccaaauaauaauguau

SEQ ID NO: 42709 - RNA, 23 nt, Homo sapiens
accacagaauccccuuuuucccc

SEQ ID NO: 42710 - RNA, 21 nt, Homo sapiens
agaacuaucucuuauaacagc

SEQ ID NO: 42711 - RNA, 14 nt, Homo sapiens
caaaugucucucua

SEQ ID NO: 42712 - RNA, 19 nt, Homo sapiens
cagacauuugaaaaaauga

SEQ ID NO: 42713 - RNA, 20 nt, Homo sapiens
cccaaacucaucugaccaca

SEQ ID NO: 42714 - RNA, 16 nt, Homo sapiens
cccggccccgccuccc

SEQ ID NO: 42715 - RNA, 19 nt, Homo sapiens
cccggccccgccucccccg

SEQ ID NO: 42716 - RNA, 21 nt, Homo sapiens
cccggccccgccucccccgcc

SEQ ID NO: 42717 - RNA, 21 nt, Homo sapiens
ccgcgccgguccugcuuucuc

SEQ ID NO: 42718 - RNA, 18 nt, Homo sapiens
cgccgaagcuacgggcgc

SEQ ID NO: 42719 - RNA, 16 nt, Homo sapiens
cuuucucgccugucca

SEQ ID NO: 42720 - RNA, 20 nt, Homo sapiens
gaaaaaaugaaaacacaguu

SEQ ID NO: 42721 - RNA, 25 nt, Homo sapiens
gcaaugauuuaaauacauguacugu

SEQ ID NO: 42722 - RNA, 17 nt, Homo sapiens
uaaaugugcaaccugga

SEQ ID NO: 42723 - RNA, 22 nt, Homo sapiens
uaacaaauaaaguuauggccug

SEQ ID NO: 42724 - RNA, 18 nt, Homo sapiens
uauggccugcuccuuuug

SEQ ID NO: 42725 - RNA, 19 nt, Homo sapiens
ucccccgccucggggcucc

SEQ ID NO: 42726 - RNA, 17 nt, Homo sapiens
ucucaguccauaagccc

SEQ ID NO: 42727 - RNA, 17 nt, Homo sapiens
ugaaguguucagcauuu

SEQ ID NO: 42728 - RNA, 18 nt, Homo sapiens
uggccugcuccuuuugca

SEQ ID NO: 42729 - RNA, 19 nt, Homo sapiens
uguacagacagugacgaug

SEQ ID NO: 42730 - RNA, 19 nt, Homo sapiens
uuagauuguuauggaaaga

SEQ ID NO: 42731 - RNA, 18 nt, Homo sapiens
uuagcccaucugcagcuu

SEQ ID NO: 42732 - RNA, 17 nt, Homo sapiens
uuccucuauguauaaau

SEQ ID NO: 42733 - RNA, 18 nt, Homo sapiens
guguuuucuauauauccc

SEQ ID NO: 42734 - RNA, 18 nt, Homo sapiens
uaaaaccgaauggaauga

SEQ ID NO: 42735 - RNA, 24 nt, Homo sapiens
uauuauauuuaacgucuuauauuu

SEQ ID NO: 42736 - RNA, 21 nt, Homo sapiens
ugguagguuuauuugguucua

SEQ ID NO: 42737 - RNA, 20 nt, Homo sapiens
aaaaauguguacagcugaag

SEQ ID NO: 42738 - RNA, 19 nt, Homo sapiens
uuacuuaaaacuuauugag

SEQ ID NO: 42739 - RNA, 16 nt, Homo sapiens
gcagccacccuggggc

SEQ ID NO: 42740 - RNA, 18 nt, Homo sapiens
gccuugucuuuucacggc

SEQ ID NO: 42741 - RNA, 20 nt, Homo sapiens
ggcccuguggaccaaaggga

SEQ ID NO: 42742 - RNA, 16 nt, Homo sapiens
accuugguuuaguguu

SEQ ID NO: 42743 - RNA, 23 nt, Homo sapiens
acugacaugccggguggaccagg

SEQ ID NO: 42744 - RNA, 19 nt, Homo sapiens
agucaaggacguuuauuuc

SEQ ID NO: 42745 - RNA, 20 nt, Homo sapiens
ugaggccgccucugucagcc

SEQ ID NO: 42746 - RNA, 18 nt, Homo sapiens
ggcaagauguucagcaac

SEQ ID NO: 42747 - RNA, 22 nt, Homo sapiens
acacagggcagagcgcccacag

SEQ ID NO: 42748 - RNA, 14 nt, Homo sapiens
cgagcggccgcggg

SEQ ID NO: 42749 - RNA, 19 nt, Homo sapiens
ggcaccgcccaagcuuuuc

SEQ ID NO: 42750 - RNA, 20 nt, Homo sapiens
gggaaggauucauuguccug

SEQ ID NO: 42751 - RNA, 21 nt, Homo sapiens
ucucugcagugccagggccac

SEQ ID NO: 42752 - RNA, 20 nt, Homo sapiens
uugcuagccuaccacaucag

SEQ ID NO: 42753 - RNA, 21 nt, Homo sapiens
aggggccgggggcugcgggag

SEQ ID NO: 42754 - RNA, 18 nt, Homo sapiens
cccugcccacccuccccc

SEQ ID NO: 42755 - RNA, 19 nt, Homo sapiens
gaugcagagggcgggcccc

SEQ ID NO: 42756 - RNA, 22 nt, Homo sapiens
gggaggggccgggggcugcggg

SEQ ID NO: 42757 - RNA, 20 nt, Homo sapiens
gggcuggggcagggccuggg

SEQ ID NO: 42758 - RNA, 22 nt, Homo sapiens
ggggaggggccgggggcugcgg

SEQ ID NO: 42759 - RNA, 18 nt, Homo sapiens
ggguacaaaggaauaagu

SEQ ID NO: 42760 - RNA, 24 nt, Homo sapiens
aagggggcggggcccacgcgcggg

SEQ ID NO: 42761 - RNA, 17 nt, Homo sapiens
cccaacucuauuggcua

SEQ ID NO: 42762 - RNA, 17 nt, Homo sapiens
gcccacgcgcgggcgcc

SEQ ID NO: 42763 - RNA, 20 nt, Homo sapiens
gggcggggcccacgcgcggg

SEQ ID NO: 42764 - RNA, 18 nt, Homo sapiens
uacccaagagaaacucag

SEQ ID NO: 42765 - RNA, 19 nt, Homo sapiens
ucaguaccacaguuuuacu

SEQ ID NO: 42766 - RNA, 15 nt, Homo sapiens
uccgccccguucucc

SEQ ID NO: 42767 - RNA, 17 nt, Homo sapiens
aaaaguugcucccuuuc

SEQ ID NO: 42768 - RNA, 21 nt, Homo sapiens
cacuggagcuaggcuggcggg

SEQ ID NO: 42769 - RNA, 22 nt, Homo sapiens
cagcagcugccaaauaagacag

SEQ ID NO: 42770 - RNA, 18 nt, Homo sapiens
gaggcagcagcugccaaa

SEQ ID NO: 42771 - RNA, 15 nt, Homo sapiens
ucuuugguagcacac

SEQ ID NO: 42772 - RNA, 19 nt, Homo sapiens
aaacucauguccauggcag

SEQ ID NO: 42773 - RNA, 19 nt, Homo sapiens
accaguucuaggagcaaac

SEQ ID NO: 42774 - RNA, 22 nt, Homo sapiens
cacagguacuuguuggagaagu

SEQ ID NO: 42775 - RNA, 19 nt, Homo sapiens
cacugauuggacuguucgc

SEQ ID NO: 42776 - RNA, 16 nt, Homo sapiens
gcuggguuuagauaag

SEQ ID NO: 42777 - RNA, 19 nt, Homo sapiens
gcuuggcgcaccacuucug

SEQ ID NO: 42778 - RNA, 19 nt, Homo sapiens
ggcgcaccacuucuggggc

SEQ ID NO: 42779 - RNA, 18 nt, Homo sapiens
ggcugcugugagguccgc

SEQ ID NO: 42780 - RNA, 20 nt, Homo sapiens
ugacauacagccaaguuuag

SEQ ID NO: 42781 - RNA, 16 nt, Homo sapiens
ugagugugauuuacca

SEQ ID NO: 42782 - RNA, 18 nt, Homo sapiens
ugugauuuaccaaaauuc

SEQ ID NO: 42783 - RNA, 15 nt, Homo sapiens
uugaaucuguuuugc

SEQ ID NO: 42784 - RNA, 22 nt, Homo sapiens
accccgacgacucucggcgaag

SEQ ID NO: 42785 - RNA, 16 nt, Homo sapiens
cgcuggagcggcggcg

SEQ ID NO: 42786 - RNA, 17 nt, Homo sapiens
cgcuggagcggcggcgg

SEQ ID NO: 42787 - RNA, 21 nt, Homo sapiens
gcggcggcgguggcugcgcgg

SEQ ID NO: 42788 - RNA, 15 nt, Homo sapiens
ggcggccggccgggg

SEQ ID NO: 42789 - RNA, 21 nt, Homo sapiens
ggcggcggcggcggcgguggc

SEQ ID NO: 42790 - RNA, 21 nt, Homo sapiens
ggcggcgguggcugcgcggcg

SEQ ID NO: 42791 - RNA, 19 nt, Homo sapiens
ggcgguggcugcgcggcgc

SEQ ID NO: 42792 - RNA, 19 nt, Homo sapiens
gggcaguccgagggugcgg

SEQ ID NO: 42793 - RNA, 19 nt, Homo sapiens
ucugauucaucccaagacc

SEQ ID NO: 42794 - RNA, 24 nt, Homo sapiens
aacugaaaggccucuacgggcagc

SEQ ID NO: 42795 - RNA, 25 nt, Homo sapiens
acggcugugugugguuggcugaugu

SEQ ID NO: 42796 - RNA, 19 nt, Homo sapiens
cagcaaaugcccaagcgcg

SEQ ID NO: 42797 - RNA, 19 nt, Homo sapiens
ccauguagcuaugggaccu

SEQ ID NO: 42798 - RNA, 19 nt, Homo sapiens
ccuuaggccaacuuucaau

SEQ ID NO: 42799 - RNA, 16 nt, Homo sapiens
gaccuugagacucuca

SEQ ID NO: 42800 - RNA, 22 nt, Homo sapiens
gagaaagagaagagagagggag

SEQ ID NO: 42801 - RNA, 21 nt, Homo sapiens
gagagagggagagagagagag

SEQ ID NO: 42802 - RNA, 18 nt, Homo sapiens
ucacagcucacugcagcc

SEQ ID NO: 42803 - RNA, 18 nt, Homo sapiens
uccccaucuggccaaauu

SEQ ID NO: 42804 - RNA, 23 nt, Homo sapiens
uccuguggaugguguaauuucug

SEQ ID NO: 42805 - RNA, 19 nt, Homo sapiens
ucuaaggaagggcagcugg

SEQ ID NO: 42806 - RNA, 20 nt, Homo sapiens
ucugugacugucuucuaaac

SEQ ID NO: 42807 - RNA, 19 nt, Homo sapiens
uggaugugugcuguucugu

SEQ ID NO: 42808 - RNA, 16 nt, Homo sapiens
aacacacacuuaaaug

SEQ ID NO: 42809 - RNA, 18 nt, Homo sapiens
gcaugugauuucagguuu

SEQ ID NO: 42810 - RNA, 21 nt, Homo sapiens
ggggaagggaaaggggagguu

SEQ ID NO: 42811 - RNA, 20 nt, Homo sapiens
uaaaaauuauggaggggaac

SEQ ID NO: 42812 - RNA, 22 nt, Homo sapiens
ugggaaaaaucagauaggaagu

SEQ ID NO: 42813 - RNA, 22 nt, Homo sapiens
uuacauaggcaugugauuucag

SEQ ID NO: 42814 - RNA, 19 nt, Homo sapiens
uuucuccuuugcaaucaag

SEQ ID NO: 42815 - RNA, 17 nt, Homo sapiens
caugcugggcuauguag

SEQ ID NO: 42816 - RNA, 15 nt, Homo sapiens
gaggcccuagcaacc

SEQ ID NO: 42817 - RNA, 16 nt, Homo sapiens
gaggcggcccgcgcug

SEQ ID NO: 42818 - RNA, 19 nt, Homo sapiens
gcgcgcgacggcaaggucu

SEQ ID NO: 42819 - RNA, 24 nt, Homo sapiens
aggaaacaaggaggcuugacugug

SEQ ID NO: 42820 - RNA, 19 nt, Homo sapiens
caaggaggcuugacuguga

SEQ ID NO: 42821 - RNA, 19 nt, Homo sapiens
ccacaccaccaucgugcac

SEQ ID NO: 42822 - RNA, 19 nt, Homo sapiens
cccgccgcucccggagccc

SEQ ID NO: 42823 - RNA, 20 nt, Homo sapiens
cgcgggugcgagugugugcg

SEQ ID NO: 42824 - RNA, 17 nt, Homo sapiens
cuaaguguuccaugugc

SEQ ID NO: 42825 - RNA, 22 nt, Homo sapiens
cugguuaaccgaacaagaggag

SEQ ID NO: 42826 - RNA, 19 nt, Homo sapiens
gagcacgggugcccgcggc

SEQ ID NO: 42827 - RNA, 22 nt, Homo sapiens
gcaacccaacaacguucaccuc

SEQ ID NO: 42828 - RNA, 16 nt, Homo sapiens
gcccgcggccgaggcc

SEQ ID NO: 42829 - RNA, 18 nt, Homo sapiens
gcgagugugugcgcccgg

SEQ ID NO: 42830 - RNA, 17 nt, Homo sapiens
gcgccgcgcgggggcgc

SEQ ID NO: 42831 - RNA, 18 nt, Homo sapiens
gcgccggccgcccgcgcc

SEQ ID NO: 42832 - RNA, 23 nt, Homo sapiens
gcucagugacccaauaccaucag

SEQ ID NO: 42833 - RNA, 16 nt, Homo sapiens
ggaggaggaaacaguc

SEQ ID NO: 42834 - RNA, 16 nt, Homo sapiens
ggccgccgagcgucuc

SEQ ID NO: 42835 - RNA, 22 nt, Homo sapiens
ggcgagcaucgcggcgguggcc

SEQ ID NO: 42836 - RNA, 20 nt, Homo sapiens
ggcgcuacaccugggagcac

SEQ ID NO: 42837 - RNA, 18 nt, Homo sapiens
uaaagaugauggagaaga

SEQ ID NO: 42838 - RNA, 19 nt, Homo sapiens
ugcucagaagugaguaaag

SEQ ID NO: 42839 - RNA, 16 nt, Homo sapiens
uggcugcguggucccg

SEQ ID NO: 42840 - RNA, 17 nt, Homo sapiens
uuuguuuucacaugacu

SEQ ID NO: 42841 - RNA, 21 nt, Homo sapiens
aaggggcagauggcuguuuau

SEQ ID NO: 42842 - RNA, 16 nt, Homo sapiens
agggaaacagaggaaa

SEQ ID NO: 42843 - RNA, 18 nt, Homo sapiens
acccuugcgguaauaguc

SEQ ID NO: 42844 - RNA, 21 nt, Homo sapiens
gagaggaggcggaaggagggc

SEQ ID NO: 42845 - RNA, 17 nt, Homo sapiens
gcccuggcccaguuccc

SEQ ID NO: 42846 - RNA, 19 nt, Homo sapiens
ggguguggacuccucucca

SEQ ID NO: 42847 - RNA, 20 nt, Homo sapiens
ucagggccacggguguggac

SEQ ID NO: 42848 - RNA, 16 nt, Homo sapiens
ucucggugcacaaacu

SEQ ID NO: 42849 - RNA, 17 nt, Homo sapiens
ucugagcgaauauccag

SEQ ID NO: 42850 - RNA, 20 nt, Homo sapiens
uuguuggcagcaagguaggc

SEQ ID NO: 42851 - RNA, 18 nt, Homo sapiens
augcuacugaucaccuga

SEQ ID NO: 42852 - RNA, 18 nt, Homo sapiens
cagcagcaaauaccggca

SEQ ID NO: 42853 - RNA, 19 nt, Homo sapiens
ugacaaaauaauaaacacu

SEQ ID NO: 42854 - RNA, 15 nt, Homo sapiens
uggcaaauaaaagcu

SEQ ID NO: 42855 - RNA, 19 nt, Homo sapiens
uguacauacauggcauauu

SEQ ID NO: 42856 - RNA, 22 nt, Homo sapiens
agcccagagacccacggggaaa

SEQ ID NO: 42857 - RNA, 17 nt, Homo sapiens
caauacaggugaaacuu

SEQ ID NO: 42858 - RNA, 22 nt, Homo sapiens
acugggguggggaagcuuauuc

SEQ ID NO: 42859 - RNA, 16 nt, Homo sapiens
ccucaggguggcugaa

SEQ ID NO: 42860 - RNA, 21 nt, Homo sapiens
ccucucucuccuccgcucucc

SEQ ID NO: 42861 - RNA, 18 nt, Homo sapiens
ucuuuuuugugaaagaaa

SEQ ID NO: 42862 - RNA, 19 nt, Homo sapiens
uggggaagcuuauucugaa

SEQ ID NO: 42863 - RNA, 18 nt, Homo sapiens
ugugaguggacgugccuu

SEQ ID NO: 42864 - RNA, 17 nt, Homo sapiens
uugcauagcgcugugaa

SEQ ID NO: 42865 - RNA, 16 nt, Homo sapiens
ccccaaccugaucccu

SEQ ID NO: 42866 - RNA, 18 nt, Homo sapiens
aggagguggggagcagga

SEQ ID NO: 42867 - RNA, 20 nt, Homo sapiens
cacggggaggggaagguucc

SEQ ID NO: 42868 - RNA, 22 nt, Homo sapiens
cugccugguacccacugggcug

SEQ ID NO: 42869 - RNA, 20 nt, Homo sapiens
gagagcagccaaggggcagg

SEQ ID NO: 42870 - RNA, 21 nt, Homo sapiens
ggccugagcccccuccuuucc

SEQ ID NO: 42871 - RNA, 16 nt, Homo sapiens
uccagaugucugggga

SEQ ID NO: 42872 - RNA, 18 nt, Homo sapiens
ucuaugcccaguguccag

SEQ ID NO: 42873 - RNA, 19 nt, Homo sapiens
ugcaguggcaugaccucgg

SEQ ID NO: 42874 - RNA, 22 nt, Homo sapiens
uggggaggcaggggagucuucc

SEQ ID NO: 42875 - RNA, 15 nt, Homo sapiens
cccaguggagggaca

SEQ ID NO: 42876 - RNA, 18 nt, Homo sapiens
ccuccuuggcugggaggg

SEQ ID NO: 42877 - RNA, 17 nt, Homo sapiens
ucgaacaucugaguggc

SEQ ID NO: 42878 - RNA, 14 nt, Homo sapiens
ucugagccuccucu

SEQ ID NO: 42879 - RNA, 18 nt, Homo sapiens
gaggccccaggagugacc

SEQ ID NO: 42880 - RNA, 21 nt, Homo sapiens
ucccaggcacugucacguggg

SEQ ID NO: 42881 - RNA, 17 nt, Homo sapiens
ugaaacugagacagugc

SEQ ID NO: 42882 - RNA, 21 nt, Homo sapiens
ugcccuuuuuaacuccugcag

SEQ ID NO: 42883 - RNA, 16 nt, Homo sapiens
acuaaaccagaacaaa

SEQ ID NO: 42884 - RNA, 19 nt, Homo sapiens
aggacuuuggugauaagca

SEQ ID NO: 42885 - RNA, 20 nt, Homo sapiens
auuuacaaaacugcauacag

SEQ ID NO: 42886 - RNA, 23 nt, Homo sapiens
ccggcccggccccuuccuucucc

SEQ ID NO: 42887 - RNA, 18 nt, Homo sapiens
cuccgccaacuggaguga

SEQ ID NO: 42888 - RNA, 20 nt, Homo sapiens
gcccggccccuuccuucucc

SEQ ID NO: 42889 - RNA, 21 nt, Homo sapiens
gcgcgaggggaggggacccgg

SEQ ID NO: 42890 - RNA, 18 nt, Homo sapiens
ggaggggacccggcccgg

SEQ ID NO: 42891 - RNA, 20 nt, Homo sapiens
guggaacaaagaggcuauga

SEQ ID NO: 42892 - RNA, 17 nt, Homo sapiens
uaacuauguagaaagac

SEQ ID NO: 42893 - RNA, 17 nt, Homo sapiens
uccauccaucaugacuu

SEQ ID NO: 42894 - RNA, 18 nt, Homo sapiens
ugagcuucucugggaagc

SEQ ID NO: 42895 - RNA, 20 nt, Homo sapiens
ugagguggaacaaagaggcu

SEQ ID NO: 42896 - RNA, 18 nt, Homo sapiens
uugaauagaggcagaugc

SEQ ID NO: 42897 - RNA, 27 nt, Homo sapiens
aaacaaacaccaaagcuuacaauauag

SEQ ID NO: 42898 - RNA, 18 nt, Homo sapiens
agacuguaacaacacaga

SEQ ID NO: 42899 - RNA, 18 nt, Homo sapiens
uguaucagauugaggugc

SEQ ID NO: 42900 - RNA, 23 nt, Homo sapiens
ccccggccucccaaaaugcuggg

SEQ ID NO: 42901 - RNA, 21 nt, Homo sapiens
gcuugaaccugcgagguggag

SEQ ID NO: 42902 - RNA, 23 nt, Homo sapiens
uauauauauauguauauauauga

SEQ ID NO: 42903 - RNA, 18 nt, Homo sapiens
acaggaaaucgccgucua

SEQ ID NO: 42904 - RNA, 22 nt, Homo sapiens
gaaauauuuguauugcacugaa

SEQ ID NO: 42905 - RNA, 18 nt, Homo sapiens
gccacaaaccagaugugu

SEQ ID NO: 42906 - RNA, 25 nt, Homo sapiens
ugugaaauauuuguauugcacugaa

SEQ ID NO: 42907 - RNA, 23 nt, Homo sapiens
caggcugccuggccucccuguau

SEQ ID NO: 42908 - RNA, 19 nt, Homo sapiens
agcacucauggagaccaug

SEQ ID NO: 42909 - RNA, 17 nt, Homo sapiens
cugcucccucauguggc

SEQ ID NO: 42910 - RNA, 16 nt, Homo sapiens
ggggagcaaggaggag

SEQ ID NO: 42911 - RNA, 19 nt, Homo sapiens
ugccaucaaaaugaggccu

SEQ ID NO: 42912 - RNA, 16 nt, Homo sapiens
agggggcggcggggug

SEQ ID NO: 42913 - RNA, 18 nt, Homo sapiens
cacuguguuguccaggcu

SEQ ID NO: 42914 - RNA, 16 nt, Homo sapiens
ccgcgaccuccacgcc

SEQ ID NO: 42915 - RNA, 19 nt, Homo sapiens
gaguguggggacagagucc

SEQ ID NO: 42916 - RNA, 16 nt, Homo sapiens
gcggcgggguguaggg

SEQ ID NO: 42917 - RNA, 18 nt, Homo sapiens
gcuguucacggccucgcc

SEQ ID NO: 42918 - RNA, 30 nt, Homo sapiens
ggagugaaggauucagugaggugccuuggc

SEQ ID NO: 42919 - RNA, 18 nt, Homo sapiens
ucacagccugcugcagcc

SEQ ID NO: 42920 - RNA, 25 nt, Homo sapiens
uccccggcucuggcagcgggcuggg

SEQ ID NO: 42921 - RNA, 23 nt, Homo sapiens
ugacuugcucaggggauccucuu

SEQ ID NO: 42922 - RNA, 18 nt, Homo sapiens
uggccugggcggcccacg

SEQ ID NO: 42923 - RNA, 19 nt, Homo sapiens
uguaggggguggagugagc

SEQ ID NO: 42924 - RNA, 23 nt, Homo sapiens
uuucuuacuauuuuugguaugau

SEQ ID NO: 42925 - RNA, 16 nt, Homo sapiens
uuuguuucggagacag

SEQ ID NO: 42926 - RNA, 17 nt, Homo sapiens
cagcauaaguuuggccc

SEQ ID NO: 42927 - RNA, 19 nt, Homo sapiens
agggcgacaucugguggcc

SEQ ID NO: 42928 - RNA, 18 nt, Homo sapiens
aggggaaggaggaggugc

SEQ ID NO: 42929 - RNA, 16 nt, Homo sapiens
cagaagccucucccag

SEQ ID NO: 42930 - RNA, 20 nt, Homo sapiens
gacccagaagccucucccag

SEQ ID NO: 42931 - RNA, 24 nt, Homo sapiens
gagcuguugguguccagggcacug

SEQ ID NO: 42932 - RNA, 16 nt, Homo sapiens
gagggcguccuggggu

SEQ ID NO: 42933 - RNA, 18 nt, Homo sapiens
gcagagcaucagggcuuu

SEQ ID NO: 42934 - RNA, 18 nt, Homo sapiens
gcgaucugagccgccaga

SEQ ID NO: 42935 - RNA, 21 nt, Homo sapiens
ggcuguggggggaucccagag

SEQ ID NO: 42936 - RNA, 21 nt, Homo sapiens
gggagccugcagugagggcgu

SEQ ID NO: 42937 - RNA, 22 nt, Homo sapiens
uaccaccuggaaacuggugagg

SEQ ID NO: 42938 - RNA, 25 nt, Homo sapiens
accauccuaagauuuuccccugccc

SEQ ID NO: 42939 - RNA, 18 nt, Homo sapiens
caaaacccaaguggccca

SEQ ID NO: 42940 - RNA, 21 nt, Homo sapiens
cagaacuggguaucccagagu

SEQ ID NO: 42941 - RNA, 16 nt, Homo sapiens
cagcauuugccacagg

SEQ ID NO: 42942 - RNA, 21 nt, Homo sapiens
caggcucuuucugaaaggcug

SEQ ID NO: 42943 - RNA, 24 nt, Homo sapiens
cauugugugugcacacgugugugu

SEQ ID NO: 42944 - RNA, 19 nt, Homo sapiens
cauuuugguaaacuucuca

SEQ ID NO: 42945 - RNA, 21 nt, Homo sapiens
ccugcuucacccucucccugg

SEQ ID NO: 42946 - RNA, 18 nt, Homo sapiens
gaaauauuugccccuuga

SEQ ID NO: 42947 - RNA, 18 nt, Homo sapiens
gaggaaugcuugagggug

SEQ ID NO: 42948 - RNA, 24 nt, Homo sapiens
gauggucauauuauauucuuucuu

SEQ ID NO: 42949 - RNA, 20 nt, Homo sapiens
gcugaagguguguguucagg

SEQ ID NO: 42950 - RNA, 17 nt, Homo sapiens
gucuuggggacauggga

SEQ ID NO: 42951 - RNA, 21 nt, Homo sapiens
gugugugcacacgugugugug

SEQ ID NO: 42952 - RNA, 16 nt, Homo sapiens
ucucucucugugagca

SEQ ID NO: 42953 - RNA, 18 nt, Homo sapiens
ucuguuugcugaccuuuc

SEQ ID NO: 42954 - RNA, 22 nt, Homo sapiens
ugaggcaggugcauuagagagu

SEQ ID NO: 42955 - RNA, 23 nt, Homo sapiens
ugcauugugugugcacacgugug

SEQ ID NO: 42956 - RNA, 23 nt, Homo sapiens
ugggagcugggagaguguuggug

SEQ ID NO: 42957 - RNA, 21 nt, Homo sapiens
ugugcacacgugugugugugu

SEQ ID NO: 42958 - RNA, 19 nt, Homo sapiens
ugugugcacacgugugugu

SEQ ID NO: 42959 - RNA, 20 nt, Homo sapiens
uguguguucaggccacugag

SEQ ID NO: 42960 - RNA, 21 nt, Homo sapiens
uuccagaugaggagcccuggu

SEQ ID NO: 42961 - RNA, 22 nt, Homo sapiens
uucccaaucaugcagauggaga

SEQ ID NO: 42962 - RNA, 22 nt, Homo sapiens
uucccagucaugagggugggga

SEQ ID NO: 42963 - RNA, 22 nt, Homo sapiens
aagaggguugauggccuccagu

SEQ ID NO: 42964 - RNA, 18 nt, Homo sapiens
aggggcuaggggcucccu

SEQ ID NO: 42965 - RNA, 19 nt, Homo sapiens
cagcugcuuccaaaauccc

SEQ ID NO: 42966 - RNA, 24 nt, Homo sapiens
ccuuuguuuugcugcuuuguucaa

SEQ ID NO: 42967 - RNA, 18 nt, Homo sapiens
ggaggugggggagcccua

SEQ ID NO: 42968 - RNA, 22 nt, Homo sapiens
ggcaggcuaaaagaccuccagu

SEQ ID NO: 42969 - RNA, 15 nt, Homo sapiens
ggggaggugggggag

SEQ ID NO: 42970 - RNA, 20 nt, Homo sapiens
uagugcaaaacaaaaaucac

SEQ ID NO: 42971 - RNA, 18 nt, Homo sapiens
uauuacagugggaauuac

SEQ ID NO: 42972 - RNA, 19 nt, Homo sapiens
ucaacauccaucuagcaga

SEQ ID NO: 42973 - RNA, 21 nt, Homo sapiens
accaacccaccccccaacccg

SEQ ID NO: 42974 - RNA, 20 nt, Homo sapiens
agcuggcauuguuuccacug

SEQ ID NO: 42975 - RNA, 16 nt, Homo sapiens
caccaacccacccccc

SEQ ID NO: 42976 - RNA, 22 nt, Homo sapiens
cagcacaaaucaaagcccaaua

SEQ ID NO: 42977 - RNA, 25 nt, Homo sapiens
cccccaccucucuucgaccguuugg

SEQ ID NO: 42978 - RNA, 18 nt, Homo sapiens
cugugggcaaaaaagggg

SEQ ID NO: 42979 - RNA, 17 nt, Homo sapiens
ggaaauccaagaaaaag

SEQ ID NO: 42980 - RNA, 19 nt, Homo sapiens
ucuaaacaaauaaggagaa

SEQ ID NO: 42981 - RNA, 14 nt, Homo sapiens
uggcacccaaagcc

SEQ ID NO: 42982 - RNA, 20 nt, Homo sapiens
ugugggcaaaaaaggggagu

SEQ ID NO: 42983 - RNA, 25 nt, Homo sapiens
uuucccaggcuggagauaagaauga

SEQ ID NO: 42984 - RNA, 27 nt, Homo sapiens
aagcagccagaacuuggaaguaaguua

SEQ ID NO: 42985 - RNA, 17 nt, Homo sapiens
acaggucuuuccauucu

SEQ ID NO: 42986 - RNA, 21 nt, Homo sapiens
cggcuccucagggcuggggcc

SEQ ID NO: 42987 - RNA, 19 nt, Homo sapiens
gacaaugguggaaggguga

SEQ ID NO: 42988 - RNA, 18 nt, Homo sapiens
ucugcaccacugaagcca

SEQ ID NO: 42989 - RNA, 19 nt, Homo sapiens
ucuuuccauucuggugaaa

SEQ ID NO: 42990 - RNA, 19 nt, Homo sapiens
ugaaaaaaagaugcaauga

SEQ ID NO: 42991 - RNA, 23 nt, Homo sapiens
ugacuggauacuuguauggggga

SEQ ID NO: 42992 - RNA, 17 nt, Homo sapiens
aacagugagugucaaga

SEQ ID NO: 42993 - RNA, 23 nt, Homo sapiens
aaugacaugaacguuuauauaug

SEQ ID NO: 42994 - RNA, 19 nt, Homo sapiens
agcgauaauuauugacagu

SEQ ID NO: 42995 - RNA, 19 nt, Homo sapiens
agguaagaaaaaggaaaaa

SEQ ID NO: 42996 - RNA, 16 nt, Homo sapiens
cagaggggaaauggug

SEQ ID NO: 42997 - RNA, 19 nt, Homo sapiens
cuugauacuaguuagaaag

SEQ ID NO: 42998 - RNA, 20 nt, Homo sapiens
gaaauaagucauuuucuaug

SEQ ID NO: 42999 - RNA, 18 nt, Homo sapiens
gagugcuggcaagaccuc

SEQ ID NO: 43000 - RNA, 19 nt, Homo sapiens
gauaguuagcucuggggga

SEQ ID NO: 43001 - RNA, 21 nt, Homo sapiens
gggaagacagaaaaaggagaa

SEQ ID NO: 43002 - RNA, 21 nt, Homo sapiens
uacaaauuuuaaauguagccc

SEQ ID NO: 43003 - RNA, 20 nt, Homo sapiens
ucugcgcgggcugaggcugg

SEQ ID NO: 43004 - RNA, 22 nt, Homo sapiens
ugaaagacauguaauaaaugcu

SEQ ID NO: 43005 - RNA, 16 nt, Homo sapiens
uucacauuugcuugag

SEQ ID NO: 43006 - RNA, 18 nt, Homo sapiens
uugcuaaugggaauguaa

SEQ ID NO: 43007 - RNA, 19 nt, Homo sapiens
uuucuguaauuauucaauu

SEQ ID NO: 43008 - RNA, 17 nt, Homo sapiens
uacaauguauguacagg

SEQ ID NO: 43009 - RNA, 18 nt, Homo sapiens
uacacaagcuugauccac

SEQ ID NO: 43010 - RNA, 22 nt, Homo sapiens
acuuccacgguggggggccucu

SEQ ID NO: 43011 - RNA, 19 nt, Homo sapiens
caccccguacuugcgcucc

SEQ ID NO: 43012 - RNA, 19 nt, Homo sapiens
gccccgggcccggccgagg

SEQ ID NO: 43013 - RNA, 22 nt, Homo sapiens
gccccucugcccaggauggggc

SEQ ID NO: 43014 - RNA, 15 nt, Homo sapiens
gcccuugaccggcag

SEQ ID NO: 43015 - RNA, 19 nt, Homo sapiens
gccggcggcgcggaucugc

SEQ ID NO: 43016 - RNA, 19 nt, Homo sapiens
ggaggaaagaggauucuga

SEQ ID NO: 43017 - RNA, 19 nt, Homo sapiens
ugacguggauggcagaggg

SEQ ID NO: 43018 - RNA, 19 nt, Homo sapiens
ugcccuugaccggcaggcc

SEQ ID NO: 43019 - RNA, 17 nt, Homo sapiens
ugcgcagguccggauuc

SEQ ID NO: 43020 - RNA, 19 nt, Homo sapiens
acaggccaagguggaccag

SEQ ID NO: 43021 - RNA, 19 nt, Homo sapiens
aggaaacaaagugcccagu

SEQ ID NO: 43022 - RNA, 17 nt, Homo sapiens
aggagugaggguuucca

SEQ ID NO: 43023 - RNA, 18 nt, Homo sapiens
cgggcuccuugcuguggc

SEQ ID NO: 43024 - RNA, 18 nt, Homo sapiens
cuagugagcugggguugg

SEQ ID NO: 43025 - RNA, 18 nt, Homo sapiens
gggguuugugucacagaa

SEQ ID NO: 43026 - RNA, 22 nt, Homo sapiens
ggguugggaugggauggcaggg

SEQ ID NO: 43027 - RNA, 19 nt, Homo sapiens
gucucaggccuuuggcccc

SEQ ID NO: 43028 - RNA, 17 nt, Homo sapiens
uagcaggcugugguggu

SEQ ID NO: 43029 - RNA, 18 nt, Homo sapiens
ugcccgagucaucugugu

SEQ ID NO: 43030 - RNA, 16 nt, Homo sapiens
ugguggugggcgccug

SEQ ID NO: 43031 - RNA, 17 nt, Homo sapiens
uugggaggccaaggugg

SEQ ID NO: 43032 - RNA, 18 nt, Homo sapiens
aguggcggcuagcgccgc

SEQ ID NO: 43033 - RNA, 18 nt, Homo sapiens
cacuucucuucccacagg

SEQ ID NO: 43034 - RNA, 20 nt, Homo sapiens
caguggcggcuagcgccgcc

SEQ ID NO: 43035 - RNA, 17 nt, Homo sapiens
gcggcuagcgccgccgc

SEQ ID NO: 43036 - RNA, 19 nt, Homo sapiens
acgcugggggguggggaag

SEQ ID NO: 43037 - RNA, 19 nt, Homo sapiens
agcuaguucuauauagcag

SEQ ID NO: 43038 - RNA, 19 nt, Homo sapiens
auaguguguuugguguuuu

SEQ ID NO: 43039 - RNA, 15 nt, Homo sapiens
aucuccucuucagcu

SEQ ID NO: 43040 - RNA, 21 nt, Homo sapiens
augagaaugaacaggaacaag

SEQ ID NO: 43041 - RNA, 19 nt, Homo sapiens
augagacacacaauauaca

SEQ ID NO: 43042 - RNA, 16 nt, Homo sapiens
caccgggcgcugacag

SEQ ID NO: 43043 - RNA, 21 nt, Homo sapiens
caggagcuaugggaugguauu

SEQ ID NO: 43044 - RNA, 21 nt, Homo sapiens
cccgacgggccucuuccccau

SEQ ID NO: 43045 - RNA, 25 nt, Homo sapiens
ccgagcugaggccccgaugaccucc

SEQ ID NO: 43046 - RNA, 22 nt, Homo sapiens
cgguggcaaagaccugaugaug

SEQ ID NO: 43047 - RNA, 21 nt, Homo sapiens
cugcuccuccaggucugugau

SEQ ID NO: 43048 - RNA, 18 nt, Homo sapiens
gaaagcgggaacagcagg

SEQ ID NO: 43049 - RNA, 16 nt, Homo sapiens
gagcuggcgcuugagc

SEQ ID NO: 43050 - RNA, 18 nt, Homo sapiens
gaggcgggccuaagaguc

SEQ ID NO: 43051 - RNA, 22 nt, Homo sapiens
gcuguggucucuuccagcucug

SEQ ID NO: 43052 - RNA, 17 nt, Homo sapiens
ggacccaaagcaacaga

SEQ ID NO: 43053 - RNA, 21 nt, Homo sapiens
ggagguuggccaacugaccgg

SEQ ID NO: 43054 - RNA, 15 nt, Homo sapiens
gggcaggcaccgggc

SEQ ID NO: 43055 - RNA, 18 nt, Homo sapiens
ucagccaccugccccucc

SEQ ID NO: 43056 - RNA, 18 nt, Homo sapiens
ucccgacgggccucuucc

SEQ ID NO: 43057 - RNA, 22 nt, Homo sapiens
ucugcuccucgugcucuagacu

SEQ ID NO: 43058 - RNA, 23 nt, Homo sapiens
ugagcugcggcugcuuucucaaa

SEQ ID NO: 43059 - RNA, 19 nt, Homo sapiens
ugcagggaggugcccaggg

SEQ ID NO: 43060 - RNA, 19 nt, Homo sapiens
ugggaggggaagucgucaa

SEQ ID NO: 43061 - RNA, 21 nt, Homo sapiens
ugggggguggggaaggaaagc

SEQ ID NO: 43062 - RNA, 19 nt, Homo sapiens
ugguuuuucuggcugagau

SEQ ID NO: 43063 - RNA, 20 nt, Homo sapiens
ugugaaugcuuugaaagagu

SEQ ID NO: 43064 - RNA, 18 nt, Homo sapiens
uguucagugcuacagacu

SEQ ID NO: 43065 - RNA, 21 nt, Homo sapiens
uucaauuuccucuuuuuuuuu

SEQ ID NO: 43066 - RNA, 25 nt, Homo sapiens
uugguuguugaguucagcguugucc

SEQ ID NO: 43067 - RNA, 21 nt, Homo sapiens
cacaggaaaaggugagagaug

SEQ ID NO: 43068 - RNA, 22 nt, Homo sapiens
gccauuugcugaggcgcaugcg

SEQ ID NO: 43069 - RNA, 17 nt, Homo sapiens
accgcagccgccccgcg

SEQ ID NO: 43070 - RNA, 15 nt, Homo sapiens
caccgcagccgcccc

SEQ ID NO: 43071 - RNA, 18 nt, Homo sapiens
gccuggggagacucccca

SEQ ID NO: 43072 - RNA, 17 nt, Homo sapiens
guuaucucucgugagcc

SEQ ID NO: 43073 - RNA, 19 nt, Homo sapiens
ugagugagaguggcggcug

SEQ ID NO: 43074 - RNA, 16 nt, Homo sapiens
ugccagccucuucucc

SEQ ID NO: 43075 - RNA, 20 nt, Homo sapiens
ugcuccucucuccuucauug

SEQ ID NO: 43076 - RNA, 18 nt, Homo sapiens
ugcugcaggcccagaccg

SEQ ID NO: 43077 - RNA, 19 nt, Homo sapiens
ugggaggaaagggaggggg

SEQ ID NO: 43078 - RNA, 19 nt, Homo sapiens
uggggagacuccccaguug

SEQ ID NO: 43079 - RNA, 19 nt, Homo sapiens
cagcauggugacuugacua

SEQ ID NO: 43080 - RNA, 19 nt, Homo sapiens
gccccccuucuccuccucc

SEQ ID NO: 43081 - RNA, 22 nt, Homo sapiens
gcggcucggggcuagagcgucg

SEQ ID NO: 43082 - RNA, 19 nt, Homo sapiens
uugauggccaggaccucuu

SEQ ID NO: 43083 - RNA, 22 nt, Homo sapiens
agcuuuacugucagucagugga

SEQ ID NO: 43084 - RNA, 21 nt, Homo sapiens
acugugugugugugugugugu

SEQ ID NO: 43085 - RNA, 22 nt, Homo sapiens
acugugugugugugugugugua

SEQ ID NO: 43086 - RNA, 20 nt, Homo sapiens
auuuccccuuuuauccuggg

SEQ ID NO: 43087 - RNA, 15 nt, Homo sapiens
ccucaagggagugca

SEQ ID NO: 43088 - RNA, 19 nt, Homo sapiens
gagguccuuguggauucuu

SEQ ID NO: 43089 - RNA, 18 nt, Homo sapiens
ggccuuccagagaggugg

SEQ ID NO: 43090 - RNA, 18 nt, Homo sapiens
uccgcgggcccgcgggag

SEQ ID NO: 43091 - RNA, 16 nt, Homo sapiens
ugguugauaacuugag

SEQ ID NO: 43092 - RNA, 18 nt, Homo sapiens
ugugugugugugugugug

SEQ ID NO: 43093 - RNA, 17 nt, Homo sapiens
uucagcuugucucacug

SEQ ID NO: 43094 - RNA, 18 nt, Homo sapiens
uccaacucuggucaaagu

SEQ ID NO: 43095 - RNA, 17 nt, Homo sapiens
aggaggaggaggagaag

SEQ ID NO: 43096 - RNA, 21 nt, Homo sapiens
auaccccaacaaacuuaaacc

SEQ ID NO: 43097 - RNA, 19 nt, Homo sapiens
augcugugguguuuggaaa

SEQ ID NO: 43098 - RNA, 22 nt, Homo sapiens
augcuuguaauuucuagaaaca

SEQ ID NO: 43099 - RNA, 19 nt, Homo sapiens
auuguaguuuacucaauag

SEQ ID NO: 43100 - RNA, 16 nt, Homo sapiens
cauuuuaguaguuccc

SEQ ID NO: 43101 - RNA, 23 nt, Homo sapiens
gaggaggaggaggagaagcggga

SEQ ID NO: 43102 - RNA, 21 nt, Homo sapiens
ucuggaacuucugacaaucug

SEQ ID NO: 43103 - RNA, 19 nt, Homo sapiens
ugacagaugaagaaauaug

SEQ ID NO: 43104 - RNA, 22 nt, Homo sapiens
uggaggaggaggaggagaagcg

SEQ ID NO: 43105 - RNA, 21 nt, Homo sapiens
uuauaugcuuguaauuucuag

SEQ ID NO: 43106 - RNA, 17 nt, Homo sapiens
uuuacaguucucacagg

SEQ ID NO: 43107 - RNA, 19 nt, Homo sapiens
uuuacccauugcaaauaug

SEQ ID NO: 43108 - RNA, 25 nt, Homo sapiens
ccggggaggggggaagcuggggguu

SEQ ID NO: 43109 - RNA, 16 nt, Homo sapiens
gcccugagaggcucgg

SEQ ID NO: 43110 - RNA, 24 nt, Homo sapiens
gguauccugcugcccccugcccug

SEQ ID NO: 43111 - RNA, 18 nt, Homo sapiens
uccgacuccagcuccggu

SEQ ID NO: 43112 - RNA, 18 nt, Homo sapiens
uggcccugagaggcucgg

SEQ ID NO: 43113 - RNA, 18 nt, Homo sapiens
uugcugcagcagggacgc

SEQ ID NO: 43114 - RNA, 23 nt, Homo sapiens
aagcgaaaaaaaugagguggaag

SEQ ID NO: 43115 - RNA, 19 nt, Homo sapiens
agcaauuuccucagaaauc

SEQ ID NO: 43116 - RNA, 21 nt, Homo sapiens
gcgaaaaaaaugagguggaag

SEQ ID NO: 43117 - RNA, 18 nt, Homo sapiens
ucccacccccuaaagucu

SEQ ID NO: 43118 - RNA, 20 nt, Homo sapiens
ccuggacuggggcuuauccc

SEQ ID NO: 43119 - RNA, 23 nt, Homo sapiens
cugcaacccuuucaccccuucug

SEQ ID NO: 43120 - RNA, 18 nt, Homo sapiens
uggaagacucgcugggca

SEQ ID NO: 43121 - RNA, 16 nt, Homo sapiens
uucaaggugcacugcg

SEQ ID NO: 43122 - RNA, 22 nt, Homo sapiens
aauggagggcagggaggggccg

SEQ ID NO: 43123 - RNA, 18 nt, Homo sapiens
ccuggcuaugucccuggc

SEQ ID NO: 43124 - RNA, 17 nt, Homo sapiens
ggaggucaggagcagga

SEQ ID NO: 43125 - RNA, 21 nt, Homo sapiens
ggagugggugaagacccuccg

SEQ ID NO: 43126 - RNA, 18 nt, Homo sapiens
ggccagguccaugucugg

SEQ ID NO: 43127 - RNA, 20 nt, Homo sapiens
gggccgggagggggcguggg

SEQ ID NO: 43128 - RNA, 21 nt, Homo sapiens
ugaaggggaugauguguggcu

SEQ ID NO: 43129 - RNA, 20 nt, Homo sapiens
ugcugcaccgucuccuuguu

SEQ ID NO: 43130 - RNA, 22 nt, Homo sapiens
uggugacgccggccgcgcagga

SEQ ID NO: 43131 - RNA, 22 nt, Homo sapiens
uagagaaccaggugggagguca

SEQ ID NO: 43132 - RNA, 25 nt, Homo sapiens
uauugggggucgucauaacccgggg

SEQ ID NO: 43133 - RNA, 24 nt, Homo sapiens
ugcagccaaauucgccaugugccu

SEQ ID NO: 43134 - RNA, 19 nt, Homo sapiens
aauccuauaggucuaucuu

SEQ ID NO: 43135 - RNA, 21 nt, Homo sapiens
agaaagaggucaacaaaguuu

SEQ ID NO: 43136 - RNA, 20 nt, Homo sapiens
ccagccugggagacagagca

SEQ ID NO: 43137 - RNA, 24 nt, Homo sapiens
ccuagaccaauguuguccaauagc

SEQ ID NO: 43138 - RNA, 19 nt, Homo sapiens
cuuacggaacuuaacugga

SEQ ID NO: 43139 - RNA, 17 nt, Homo sapiens
ggccaggaguucgagac

SEQ ID NO: 43140 - RNA, 22 nt, Homo sapiens
gggaaaauacaaaauauauguc

SEQ ID NO: 43141 - RNA, 18 nt, Homo sapiens
gucuaagcacauuuaaaa

SEQ ID NO: 43142 - RNA, 18 nt, Homo sapiens
uaugugugugugugugug

SEQ ID NO: 43143 - RNA, 23 nt, Homo sapiens
ugccuguaaucccaacacuuugg

SEQ ID NO: 43144 - RNA, 19 nt, Homo sapiens
uguaugugugugugugugu

SEQ ID NO: 43145 - RNA, 21 nt, Homo sapiens
uguguaugugugugugugugu

SEQ ID NO: 43146 - RNA, 18 nt, Homo sapiens
ugugugugugugugugug

SEQ ID NO: 43147 - RNA, 19 nt, Homo sapiens
ugugugugugugugugugu

SEQ ID NO: 43148 - RNA, 18 nt, Homo sapiens
uuaguguaacaaauucaa

SEQ ID NO: 43149 - RNA, 22 nt, Homo sapiens
uccauuuaaguuuccagaaaua

SEQ ID NO: 43150 - RNA, 20 nt, Homo sapiens
aaucucuggacacauuuucu

SEQ ID NO: 43151 - RNA, 19 nt, Homo sapiens
cccgccgcccucgcagccc

SEQ ID NO: 43152 - RNA, 18 nt, Homo sapiens
ccggccccggguucgggc

SEQ ID NO: 43153 - RNA, 22 nt, Homo sapiens
ccgggagccggcgguggcgccc

SEQ ID NO: 43154 - RNA, 18 nt, Homo sapiens
cugggcugccgggagccg

SEQ ID NO: 43155 - RNA, 18 nt, Homo sapiens
gccccggguucgggcccc

SEQ ID NO: 43156 - RNA, 15 nt, Homo sapiens
gccggcgguggcgcc

SEQ ID NO: 43157 - RNA, 17 nt, Homo sapiens
gggcccccgccgcccuc

SEQ ID NO: 43158 - RNA, 20 nt, Homo sapiens
gucuccacgcugggcugccg

SEQ ID NO: 43159 - RNA, 17 nt, Homo sapiens
uacaauacuguaccagu

SEQ ID NO: 43160 - RNA, 19 nt, Homo sapiens
ugaaauacagugcaacaga

SEQ ID NO: 43161 - RNA, 22 nt, Homo sapiens
uguccagggucuccacgcuggg

SEQ ID NO: 43162 - RNA, 20 nt, Homo sapiens
uucaaguuguuuuagaaaca

SEQ ID NO: 43163 - RNA, 19 nt, Homo sapiens
aaggaaguaaguuugcaca

SEQ ID NO: 43164 - RNA, 24 nt, Homo sapiens
acaaaaauuaauucuuaaccccgg

SEQ ID NO: 43165 - RNA, 20 nt, Homo sapiens
accauaaauaauuauauuuu

SEQ ID NO: 43166 - RNA, 17 nt, Homo sapiens
agcaggaagccugcucu

SEQ ID NO: 43167 - RNA, 16 nt, Homo sapiens
aggaaguuucguuacc

SEQ ID NO: 43168 - RNA, 19 nt, Homo sapiens
aggauaacaaaaauagaaa

SEQ ID NO: 43169 - RNA, 16 nt, Homo sapiens
cacuguccuacaucca

SEQ ID NO: 43170 - RNA, 22 nt, Homo sapiens
cagcucucauuuaagaaucuca

SEQ ID NO: 43171 - RNA, 24 nt, Homo sapiens
cauugccacccccaguagugggga

SEQ ID NO: 43172 - RNA, 18 nt, Homo sapiens
cauuucaaauauaaauca

SEQ ID NO: 43173 - RNA, 22 nt, Homo sapiens
ccagcccugaccaagauuucua

SEQ ID NO: 43174 - RNA, 22 nt, Homo sapiens
cuugugauaugugugugugugu

SEQ ID NO: 43175 - RNA, 21 nt, Homo sapiens
ggcccuucccacuuccuuucc

SEQ ID NO: 43176 - RNA, 18 nt, Homo sapiens
uaauugacacaacaaaau

SEQ ID NO: 43177 - RNA, 23 nt, Homo sapiens
uacagucuguccuuggcuggccc

SEQ ID NO: 43178 - RNA, 19 nt, Homo sapiens
uacauucauucucaagcuu

SEQ ID NO: 43179 - RNA, 19 nt, Homo sapiens
ugaaauauuaaaaacaaaa

SEQ ID NO: 43180 - RNA, 17 nt, Homo sapiens
ugauaugugugugugug

SEQ ID NO: 43181 - RNA, 20 nt, Homo sapiens
ugugauaugugugugugugu

SEQ ID NO: 43182 - RNA, 17 nt, Homo sapiens
uucacagcaacacagac

SEQ ID NO: 43183 - RNA, 17 nt, Homo sapiens
caaauucauugcuguga

SEQ ID NO: 43184 - RNA, 15 nt, Homo sapiens
cccugcuccccuccc

SEQ ID NO: 43185 - RNA, 16 nt, Homo sapiens
cccugcuccccucccc

SEQ ID NO: 43186 - RNA, 19 nt, Homo sapiens
ccgccgcccugacucuccg

SEQ ID NO: 43187 - RNA, 21 nt, Homo sapiens
gcuuucuaccucuaccacaga

SEQ ID NO: 43188 - RNA, 26 nt, Homo sapiens
ucaaaacaauacuuaucaccauacag

SEQ ID NO: 43189 - RNA, 18 nt, Homo sapiens
ucggccccucccugcucc

SEQ ID NO: 43190 - RNA, 22 nt, Homo sapiens
ucugaaaaugaaguuagcuguc

SEQ ID NO: 43191 - RNA, 20 nt, Homo sapiens
ugaaagcauggaagaaaaac

SEQ ID NO: 43192 - RNA, 17 nt, Homo sapiens
uucaaaugguuuuagag

SEQ ID NO: 43193 - RNA, 17 nt, Homo sapiens
aaacaggaugugcaugu

SEQ ID NO: 43194 - RNA, 18 nt, Homo sapiens
agaggaggaagaggaugg

SEQ ID NO: 43195 - RNA, 20 nt, Homo sapiens
aggccggggagugggcuggg

SEQ ID NO: 43196 - RNA, 19 nt, Homo sapiens
auauuugucucccucugaa

SEQ ID NO: 43197 - RNA, 18 nt, Homo sapiens
cuggcuaaggccggggag

SEQ ID NO: 43198 - RNA, 19 nt, Homo sapiens
gaggaggaagaggaugggg

SEQ ID NO: 43199 - RNA, 19 nt, Homo sapiens
ggauagacgaaaauggaaa

SEQ ID NO: 43200 - RNA, 20 nt, Homo sapiens
guccaggguagguagguucc

SEQ ID NO: 43201 - RNA, 21 nt, Homo sapiens
ucuggcuaaggccggggagug

SEQ ID NO: 43202 - RNA, 18 nt, Homo sapiens
ugacaaugaaaaguccca

SEQ ID NO: 43203 - RNA, 21 nt, Homo sapiens
ugcauguuaccauggcagcaa

SEQ ID NO: 43204 - RNA, 25 nt, Homo sapiens
uggggugaugccaagaggauuguca

SEQ ID NO: 43205 - RNA, 19 nt, Homo sapiens
ugucacgaugauugguguc

SEQ ID NO: 43206 - RNA, 17 nt, Homo sapiens
auugauuccugucaguu

SEQ ID NO: 43207 - RNA, 18 nt, Homo sapiens
caccauaugagaaauuac

SEQ ID NO: 43208 - RNA, 17 nt, Homo sapiens
cccgcgccggcccggcc

SEQ ID NO: 43209 - RNA, 15 nt, Homo sapiens
gagagagagagagag

SEQ ID NO: 43210 - RNA, 17 nt, Homo sapiens
gagagagagagagagaa

SEQ ID NO: 43211 - RNA, 21 nt, Homo sapiens
gagagaggaagagagagagag

SEQ ID NO: 43212 - RNA, 22 nt, Homo sapiens
gagaggagaaagagggagagag

SEQ ID NO: 43213 - RNA, 17 nt, Homo sapiens
gagggggcggcugcggc

SEQ ID NO: 43214 - RNA, 21 nt, Homo sapiens
gcccgcgcgcccgccuccgcc

SEQ ID NO: 43215 - RNA, 19 nt, Homo sapiens
gcccgcucgcgccgccgcc

SEQ ID NO: 43216 - RNA, 21 nt, Homo sapiens
gcgccggcccggccgggugcc

SEQ ID NO: 43217 - RNA, 23 nt, Homo sapiens
ggcggcugcggcgccgcgcggcc

SEQ ID NO: 43218 - RNA, 19 nt, Homo sapiens
ggcguaauccauuauagug

SEQ ID NO: 43219 - RNA, 17 nt, Homo sapiens
ggggggagggggugugg

SEQ ID NO: 43220 - RNA, 18 nt, Homo sapiens
ggggugugggggaggggg

SEQ ID NO: 43221 - RNA, 19 nt, Homo sapiens
gggugugggggagggggcg

SEQ ID NO: 43222 - RNA, 19 nt, Homo sapiens
gugagagaggagaaagagg

SEQ ID NO: 43223 - RNA, 19 nt, Homo sapiens
guuacagaaaaacauugcc

SEQ ID NO: 43224 - RNA, 18 nt, Homo sapiens
ugacugucccguuauaua

SEQ ID NO: 43225 - RNA, 18 nt, Homo sapiens
uguuacagaaaaacauug

SEQ ID NO: 43226 - RNA, 19 nt, Homo sapiens
uucacauuuccaagucgac

SEQ ID NO: 43227 - RNA, 15 nt, Homo sapiens
aagggggaggacgga

SEQ ID NO: 43228 - RNA, 19 nt, Homo sapiens
acgugguugucgaugucac

SEQ ID NO: 43229 - RNA, 19 nt, Homo sapiens
aggagugugagaccuuggu

SEQ ID NO: 43230 - RNA, 17 nt, Homo sapiens
cacccagagaggggcag

SEQ ID NO: 43231 - RNA, 19 nt, Homo sapiens
cagggguccaggcgcgccg

SEQ ID NO: 43232 - RNA, 19 nt, Homo sapiens
ccucagcucccucccuucc

SEQ ID NO: 43233 - RNA, 14 nt, Homo sapiens
cugaggaaagugac

SEQ ID NO: 43234 - RNA, 22 nt, Homo sapiens
gggaggagcugugcuggggugg

SEQ ID NO: 43235 - RNA, 21 nt, Homo sapiens
gggaggcggcaggggaggagc

SEQ ID NO: 43236 - RNA, 19 nt, Homo sapiens
gggcugggagcccaggcug

SEQ ID NO: 43237 - RNA, 20 nt, Homo sapiens
ggggaggagcugugcugggg

SEQ ID NO: 43238 - RNA, 23 nt, Homo sapiens
ggggaggagcugugcuggggugg

SEQ ID NO: 43239 - RNA, 19 nt, Homo sapiens
gguugggugguggccaggg

SEQ ID NO: 43240 - RNA, 16 nt, Homo sapiens
uacgugguugucgaug

SEQ ID NO: 43241 - RNA, 22 nt, Homo sapiens
ugaaaccgggaagcggccggga

SEQ ID NO: 43242 - RNA, 17 nt, Homo sapiens
ugaggaggaggaugagg

SEQ ID NO: 43243 - RNA, 18 nt, Homo sapiens
ugguacacacaagggaaa

SEQ ID NO: 43244 - RNA, 18 nt, Homo sapiens
uucugcccaauccaccag

SEQ ID NO: 43245 - RNA, 19 nt, Homo sapiens
agaaggaaaaagguggggu

SEQ ID NO: 43246 - RNA, 18 nt, Homo sapiens
ccacugccaugcccugga

SEQ ID NO: 43247 - RNA, 19 nt, Homo sapiens
ccgucggccgccgcgagcc

SEQ ID NO: 43248 - RNA, 18 nt, Homo sapiens
ccuggacccauuuaucac

SEQ ID NO: 43249 - RNA, 15 nt, Homo sapiens
gaggaaccagcugaa

SEQ ID NO: 43250 - RNA, 17 nt, Homo sapiens
gguggaaugcuggcucg

SEQ ID NO: 43251 - RNA, 18 nt, Homo sapiens
aggcggccaggcucuguc

SEQ ID NO: 43252 - RNA, 14 nt, Homo sapiens
caacccccauugug

SEQ ID NO: 43253 - RNA, 16 nt, Homo sapiens
cagacuuucucucacc

SEQ ID NO: 43254 - RNA, 21 nt, Homo sapiens
ccagugccugcucgucggugu

SEQ ID NO: 43255 - RNA, 20 nt, Homo sapiens
cuguaugagacacaacagaa

SEQ ID NO: 43256 - RNA, 18 nt, Homo sapiens
gagcugaugaagaugcug

SEQ ID NO: 43257 - RNA, 21 nt, Homo sapiens
gagguccucuccgggccaggc

SEQ ID NO: 43258 - RNA, 16 nt, Homo sapiens
ucucaccaacccccau

SEQ ID NO: 43259 - RNA, 16 nt, Homo sapiens
ucucccgguccuugac

SEQ ID NO: 43260 - RNA, 18 nt, Homo sapiens
aaggguuccgggagucuc

SEQ ID NO: 43261 - RNA, 21 nt, Homo sapiens
gaagaguggggaugaguggca

SEQ ID NO: 43262 - RNA, 19 nt, Homo sapiens
gcauuugcugggauauggg

SEQ ID NO: 43263 - RNA, 21 nt, Homo sapiens
guaaaguugauaaggucauga

SEQ ID NO: 43264 - RNA, 22 nt, Homo sapiens
ugggaauaagacuauuaucaag

SEQ ID NO: 43265 - RNA, 16 nt, Homo sapiens
cacaugaagccagcag

SEQ ID NO: 43266 - RNA, 17 nt, Homo sapiens
caccaggaguaccgaag

SEQ ID NO: 43267 - RNA, 18 nt, Homo sapiens
cacgaagcauguuauaug

SEQ ID NO: 43268 - RNA, 22 nt, Homo sapiens
cacugcacccagccaggccaau

SEQ ID NO: 43269 - RNA, 16 nt, Homo sapiens
caggcagguccaggga

SEQ ID NO: 43270 - RNA, 21 nt, Homo sapiens
ccacaggacaggguggaggac

SEQ ID NO: 43271 - RNA, 25 nt, Homo sapiens
ccagagggacagucgacacaacgug

SEQ ID NO: 43272 - RNA, 17 nt, Homo sapiens
ccgcggucgcccggcag

SEQ ID NO: 43273 - RNA, 18 nt, Homo sapiens
ccgcguccccgcccagca

SEQ ID NO: 43274 - RNA, 17 nt, Homo sapiens
cuguauuuuuggcucuc

SEQ ID NO: 43275 - RNA, 24 nt, Homo sapiens
gcccgggcuugggugugcgcguga

SEQ ID NO: 43276 - RNA, 20 nt, Homo sapiens
gccggaggcccgggcuuggg

SEQ ID NO: 43277 - RNA, 22 nt, Homo sapiens
gcgcucuccgccucuucuguau

SEQ ID NO: 43278 - RNA, 20 nt, Homo sapiens
uaaaauagauacuagcagau

SEQ ID NO: 43279 - RNA, 21 nt, Homo sapiens
uagcauugccacauaccaaaa

SEQ ID NO: 43280 - RNA, 20 nt, Homo sapiens
ucccaagauguguacagcuc

SEQ ID NO: 43281 - RNA, 17 nt, Homo sapiens
ucccgcggucgcccggc

SEQ ID NO: 43282 - RNA, 14 nt, Homo sapiens
ucugacugcagcau

SEQ ID NO: 43283 - RNA, 19 nt, Homo sapiens
ugcccggccgccaccuguc

SEQ ID NO: 43284 - RNA, 20 nt, Homo sapiens
uuaaaucgggugguccucgc

SEQ ID NO: 43285 - RNA, 20 nt, Homo sapiens
ggaaauaaaaacugaaccca

SEQ ID NO: 43286 - RNA, 18 nt, Homo sapiens
cucuuuccaguucucaau

SEQ ID NO: 43287 - RNA, 19 nt, Homo sapiens
gaugaagugauucccacga

SEQ ID NO: 43288 - RNA, 21 nt, Homo sapiens
uuaaucucaugauuaccauaa

SEQ ID NO: 43289 - RNA, 21 nt, Homo sapiens
aaguucugaugacauuugcag

SEQ ID NO: 43290 - RNA, 21 nt, Homo sapiens
agguggagaugcaugagguca

SEQ ID NO: 43291 - RNA, 16 nt, Homo sapiens
aucaauugaguaaugg

SEQ ID NO: 43292 - RNA, 20 nt, Homo sapiens
cacagcacagcagugccagg

SEQ ID NO: 43293 - RNA, 16 nt, Homo sapiens
cacaugguaaggguga

SEQ ID NO: 43294 - RNA, 20 nt, Homo sapiens
cuuauauaucccuuccccau

SEQ ID NO: 43295 - RNA, 17 nt, Homo sapiens
gucugaguugaauuuuu

SEQ ID NO: 43296 - RNA, 17 nt, Homo sapiens
gugccacaauaugaaca

SEQ ID NO: 43297 - RNA, 18 nt, Homo sapiens
uaugugaaagguaccuua

SEQ ID NO: 43298 - RNA, 16 nt, Homo sapiens
ucagccacccuguccu

SEQ ID NO: 43299 - RNA, 21 nt, Homo sapiens
ugccuguaagaaauaacaaca

SEQ ID NO: 43300 - RNA, 23 nt, Homo sapiens
uggaaagcagaagucuaagaggc

SEQ ID NO: 43301 - RNA, 23 nt, Homo sapiens
ugggaaggaggaggcaaugggga

SEQ ID NO: 43302 - RNA, 19 nt, Homo sapiens
uguguggcauuuguuuugu

SEQ ID NO: 43303 - RNA, 18 nt, Homo sapiens
uugagcacaauucucaac

SEQ ID NO: 43304 - RNA, 16 nt, Homo sapiens
cacauggcuauggaau

SEQ ID NO: 43305 - RNA, 16 nt, Homo sapiens
ccugaagguggguagg

SEQ ID NO: 43306 - RNA, 18 nt, Homo sapiens
cggcauagugggguggcu

SEQ ID NO: 43307 - RNA, 15 nt, Homo sapiens
cguggccggcucucc

SEQ ID NO: 43308 - RNA, 18 nt, Homo sapiens
cugaagguggguagggcg

SEQ ID NO: 43309 - RNA, 15 nt, Homo sapiens
gcgcggggcacgccg

SEQ ID NO: 43310 - RNA, 18 nt, Homo sapiens
guggggugcucccgaggg

SEQ ID NO: 43311 - RNA, 15 nt, Homo sapiens
ucgauggcaaaucgg

SEQ ID NO: 43312 - RNA, 16 nt, Homo sapiens
uggguagggcggccug

SEQ ID NO: 43313 - RNA, 18 nt, Homo sapiens
agggguaauauggccauu

SEQ ID NO: 43314 - RNA, 15 nt, Homo sapiens
aaaggagugaaggac

SEQ ID NO: 43315 - RNA, 17 nt, Homo sapiens
caaaguguauguuuugu

SEQ ID NO: 43316 - RNA, 15 nt, Homo sapiens
caccuuggccgcccc

SEQ ID NO: 43317 - RNA, 19 nt, Homo sapiens
cacucagaucacacccccc

SEQ ID NO: 43318 - RNA, 22 nt, Homo sapiens
cagggucggacgcacagcccaa

SEQ ID NO: 43319 - RNA, 16 nt, Homo sapiens
ccaggcccacaccugg

SEQ ID NO: 43320 - RNA, 16 nt, Homo sapiens
cgaggggacacccugc

SEQ ID NO: 43321 - RNA, 16 nt, Homo sapiens
gagaggcagccggaca

SEQ ID NO: 43322 - RNA, 21 nt, Homo sapiens
ggaggcuggccaggccccugg

SEQ ID NO: 43323 - RNA, 19 nt, Homo sapiens
ggcaaaggagugaaggaca

SEQ ID NO: 43324 - RNA, 21 nt, Homo sapiens
ggggggacgggggggcucagg

SEQ ID NO: 43325 - RNA, 22 nt, Homo sapiens
gggggggacgggggggcucagg

SEQ ID NO: 43326 - RNA, 18 nt, Homo sapiens
ggggggggggacgggggg

SEQ ID NO: 43327 - RNA, 21 nt, Homo sapiens
gggggggggggggacgggggg

SEQ ID NO: 43328 - RNA, 20 nt, Homo sapiens
uaacggugggagucucagga

SEQ ID NO: 43329 - RNA, 22 nt, Homo sapiens
ugcagggaggggcaugaagggc

SEQ ID NO: 43330 - RNA, 18 nt, Homo sapiens
ugcaucuaccauggggcc

SEQ ID NO: 43331 - RNA, 19 nt, Homo sapiens
ugccacagugaccacugcc

SEQ ID NO: 43332 - RNA, 19 nt, Homo sapiens
uggagagaggccugggugc

SEQ ID NO: 43333 - RNA, 18 nt, Homo sapiens
uggcuuuagaagaauaag

SEQ ID NO: 43334 - RNA, 18 nt, Homo sapiens
uggggugggguggggggu

SEQ ID NO: 43335 - RNA, 14 nt, Homo sapiens
uuucagagagcugu

SEQ ID NO: 43336 - RNA, 19 nt, Homo sapiens
aggcaggcaaugcaaggcc

SEQ ID NO: 43337 - RNA, 17 nt, Homo sapiens
cacagccgcacccuccc

SEQ ID NO: 43338 - RNA, 16 nt, Homo sapiens
ggaccugggguggggc

SEQ ID NO: 43339 - RNA, 18 nt, Homo sapiens
ggguggggcugagggugg

SEQ ID NO: 43340 - RNA, 21 nt, Homo sapiens
ggguggggcugagggugggga

SEQ ID NO: 43341 - RNA, 22 nt, Homo sapiens
ugaggcccacggugggccaggc

SEQ ID NO: 43342 - RNA, 18 nt, Homo sapiens
agcucagggaggcagccc

SEQ ID NO: 43343 - RNA, 23 nt, Homo sapiens
caacagccugacauggcgcucaa

SEQ ID NO: 43344 - RNA, 20 nt, Homo sapiens
cccccacccccuuuuagguc

SEQ ID NO: 43345 - RNA, 19 nt, Homo sapiens
gagagggagguggggcccu

SEQ ID NO: 43346 - RNA, 17 nt, Homo sapiens
gcucugucuccccuccc

SEQ ID NO: 43347 - RNA, 20 nt, Homo sapiens
ugacacaccagugggagcug

SEQ ID NO: 43348 - RNA, 16 nt, Homo sapiens
ugcagugacacaccag

SEQ ID NO: 43349 - RNA, 18 nt, Homo sapiens
ugccgaggguagagggag

SEQ ID NO: 43350 - RNA, 18 nt, Homo sapiens
agcacaaugcagccccgg

SEQ ID NO: 43351 - RNA, 22 nt, Homo sapiens
agcuaagucacggaaacaccca

SEQ ID NO: 43352 - RNA, 18 nt, Homo sapiens
cgagucucaagagauccg

SEQ ID NO: 43353 - RNA, 16 nt, Homo sapiens
cgugacaauugaagac

SEQ ID NO: 43354 - RNA, 15 nt, Homo sapiens
gagagagagagagag

SEQ ID NO: 43355 - RNA, 23 nt, Homo sapiens
uaacugccucuuaguaaucaaga

SEQ ID NO: 43356 - RNA, 16 nt, Homo sapiens
uccucagucaugugga

SEQ ID NO: 43357 - RNA, 19 nt, Homo sapiens
uguuccuccaguccugauc

SEQ ID NO: 43358 - RNA, 20 nt, Homo sapiens
cuacugucucugacugcaga

SEQ ID NO: 43359 - RNA, 15 nt, Homo sapiens
cugccuuccucuucu

SEQ ID NO: 43360 - RNA, 21 nt, Homo sapiens
gccugcucguggcgggauccu

SEQ ID NO: 43361 - RNA, 23 nt, Homo sapiens
gccuggagcugucucgugccugc

SEQ ID NO: 43362 - RNA, 23 nt, Homo sapiens
gcggacucuugguggcucugcug

SEQ ID NO: 43363 - RNA, 22 nt, Homo sapiens
uacgcagaaucuugugaaagac

SEQ ID NO: 43364 - RNA, 20 nt, Homo sapiens
ugccuggagcugucucgugc

SEQ ID NO: 43365 - RNA, 18 nt, Homo sapiens
ugucuagagcugucagcc

SEQ ID NO: 43366 - RNA, 22 nt, Homo sapiens
uguggcugugaugggacccuga

SEQ ID NO: 43367 - RNA, 24 nt, Homo sapiens
ugugucugacucuucugaaugucc

SEQ ID NO: 43368 - RNA, 19 nt, Homo sapiens
gcccccugucuuccuaucg

SEQ ID NO: 43369 - RNA, 19 nt, Homo sapiens
gcuuuuaugaaaggggaaa

SEQ ID NO: 43370 - RNA, 19 nt, Homo sapiens
uacccgucacaaccaccac

SEQ ID NO: 43371 - RNA, 16 nt, Homo sapiens
ucuguuuuccuccucu

SEQ ID NO: 43372 - RNA, 19 nt, Homo sapiens
caauauuaacgcuaagcuu

SEQ ID NO: 43373 - RNA, 19 nt, Homo sapiens
caccuuagguacaaaauau

SEQ ID NO: 43374 - RNA, 18 nt, Homo sapiens
uaaacuccuuuauuuugu

SEQ ID NO: 43375 - RNA, 18 nt, Homo sapiens
uguugauagcuuuaaagc

SEQ ID NO: 43376 - RNA, 18 nt, Homo sapiens
aacgcgcgggcuuggccc

SEQ ID NO: 43377 - RNA, 18 nt, Homo sapiens
ccccggugcccauggcug

SEQ ID NO: 43378 - RNA, 17 nt, Homo sapiens
ggggaacgaaaaaacac

SEQ ID NO: 43379 - RNA, 19 nt, Homo sapiens
gggggcggguggggggaac

SEQ ID NO: 43380 - RNA, 20 nt, Homo sapiens
gggggcggguggggggaacg

SEQ ID NO: 43381 - RNA, 18 nt, Homo sapiens
ggggggaacgaaaaaaca

SEQ ID NO: 43382 - RNA, 19 nt, Homo sapiens
uuuccaucugcugggggcg

SEQ ID NO: 43383 - RNA, 21 nt, Homo sapiens
agcagggugggccgggggagc

SEQ ID NO: 43384 - RNA, 20 nt, Homo sapiens
agggccaagagggacgccuu

SEQ ID NO: 43385 - RNA, 20 nt, Homo sapiens
ccaaggacgccugguucccc

SEQ ID NO: 43386 - RNA, 23 nt, Homo sapiens
ccccagcccucccucaagcuccc

SEQ ID NO: 43387 - RNA, 25 nt, Homo sapiens
ccccagccucggagccuggccugag

SEQ ID NO: 43388 - RNA, 22 nt, Homo sapiens
ccucagcuccgccuucccuccc

SEQ ID NO: 43389 - RNA, 22 nt, Homo sapiens
cgguaggggagggcuggaaaga

SEQ ID NO: 43390 - RNA, 18 nt, Homo sapiens
cuuuuccuccagaaagau

SEQ ID NO: 43391 - RNA, 20 nt, Homo sapiens
gacggggugggagggguggg

SEQ ID NO: 43392 - RNA, 24 nt, Homo sapiens
gaggccgccaucuuaacugcccuc

SEQ ID NO: 43393 - RNA, 15 nt, Homo sapiens
gcaagccuugcuccu

SEQ ID NO: 43394 - RNA, 19 nt, Homo sapiens
gcagcaguuggcagugcgg

SEQ ID NO: 43395 - RNA, 23 nt, Homo sapiens
gcgcgcuccucucucugcuuucc

SEQ ID NO: 43396 - RNA, 18 nt, Homo sapiens
gcucuucccuuucuucuc

SEQ ID NO: 43397 - RNA, 19 nt, Homo sapiens
ggaaagaagagggggaggg

SEQ ID NO: 43398 - RNA, 20 nt, Homo sapiens
uccuguggggucacugagca

SEQ ID NO: 43399 - RNA, 23 nt, Homo sapiens
ugcagcaguuggcagugcggccu

SEQ ID NO: 43400 - RNA, 18 nt, Homo sapiens
ugggccgggggagccuga

SEQ ID NO: 43401 - RNA, 17 nt, Homo sapiens
caagggauguuaaucuu

SEQ ID NO: 43402 - RNA, 21 nt, Homo sapiens
uagaaaauagcaaaugauuuu

SEQ ID NO: 43403 - RNA, 15 nt, Homo sapiens
ucaagaaaucuucug

SEQ ID NO: 43404 - RNA, 18 nt, Homo sapiens
ugguuaaaauaugagaaa

SEQ ID NO: 43405 - RNA, 19 nt, Homo sapiens
caaaauuuuuacaaagaga

SEQ ID NO: 43406 - RNA, 19 nt, Homo sapiens
caccuuccccuaauucaac

SEQ ID NO: 43407 - RNA, 20 nt, Homo sapiens
gacugcaacaaagaaaaucc

SEQ ID NO: 43408 - RNA, 20 nt, Homo sapiens
ucaauauuuucccauguauu

SEQ ID NO: 43409 - RNA, 19 nt, Homo sapiens
ugacgaggaggcucauggu

SEQ ID NO: 43410 - RNA, 18 nt, Homo sapiens
agcuaguauauauggugg

SEQ ID NO: 43411 - RNA, 23 nt, Homo sapiens
uguguauguauaguguuguauuu

SEQ ID NO: 43412 - RNA, 19 nt, Homo sapiens
uuucaaauuauagaaguug

SEQ ID NO: 43413 - RNA, 19 nt, Homo sapiens
cucgcgcccuccacucggc

SEQ ID NO: 43414 - RNA, 23 nt, Homo sapiens
ggacaaaguguggacuguugcuu

SEQ ID NO: 43415 - RNA, 17 nt, Homo sapiens
cagggguguuccuguau

SEQ ID NO: 43416 - RNA, 17 nt, Homo sapiens
acuugcagaacucugga

SEQ ID NO: 43417 - RNA, 17 nt, Homo sapiens
cgccauguugguuaggc

SEQ ID NO: 43418 - RNA, 15 nt, Homo sapiens
cuugcagaacucugg

SEQ ID NO: 43419 - RNA, 19 nt, Homo sapiens
aaaguguauguucugguau

SEQ ID NO: 43420 - RNA, 22 nt, Homo sapiens
acaggguuucaccagguuggcc

SEQ ID NO: 43421 - RNA, 17 nt, Homo sapiens
caccacgcccggccccc

SEQ ID NO: 43422 - RNA, 18 nt, Homo sapiens
ccgcggcccugcugcccc

SEQ ID NO: 43423 - RNA, 21 nt, Homo sapiens
guugcuucucaauuauaacua

SEQ ID NO: 43424 - RNA, 20 nt, Homo sapiens
uaagagaaaaggacuuuauu

SEQ ID NO: 43425 - RNA, 21 nt, Homo sapiens
uaagucucguuggucuaauac

SEQ ID NO: 43426 - RNA, 15 nt, Homo sapiens
ucagagcaccaaugg

SEQ ID NO: 43427 - RNA, 19 nt, Homo sapiens
ccccucccgggccagcugg

SEQ ID NO: 43428 - RNA, 19 nt, Homo sapiens
uggcacugugugaccugug

SEQ ID NO: 43429 - RNA, 20 nt, Homo sapiens
caauguggugcugagucgag

SEQ ID NO: 43430 - RNA, 20 nt, Homo sapiens
gcucugcuuuauugaccuca

SEQ ID NO: 43431 - RNA, 23 nt, Homo sapiens
ugagucgagggguagccgauugg

SEQ ID NO: 43432 - RNA, 22 nt, Homo sapiens
ccuggagucagcgguuguuggc

SEQ ID NO: 43433 - RNA, 19 nt, Homo sapiens
uaccuuggcccccuucccc

SEQ ID NO: 43434 - RNA, 19 nt, Homo sapiens
uaucugacugaggacaaug

SEQ ID NO: 43435 - RNA, 20 nt, Homo sapiens
uccccucucaucaggcuaga

SEQ ID NO: 43436 - RNA, 18 nt, Homo sapiens
ugagguugcaacucugag

SEQ ID NO: 43437 - RNA, 18 nt, Homo sapiens
uggguaaucucugaaccu

SEQ ID NO: 43438 - RNA, 20 nt, Homo sapiens
uucaguauuucccaguugua

SEQ ID NO: 43439 - RNA, 20 nt, Homo sapiens
uucccaguuguauguccuca

SEQ ID NO: 43440 - RNA, 17 nt, Homo sapiens
ucauguucucuccaugu

SEQ ID NO: 43441 - RNA, 18 nt, Homo sapiens
acaacauauuuauaccua

SEQ ID NO: 43442 - RNA, 23 nt, Homo sapiens
auguauucggcugaaaguucagg

SEQ ID NO: 43443 - RNA, 19 nt, Homo sapiens
cacucuuguggccugggua

SEQ ID NO: 43444 - RNA, 15 nt, Homo sapiens
guauugcugggcuuc

SEQ ID NO: 43445 - RNA, 17 nt, Homo sapiens
uauugggaaugcgggga

SEQ ID NO: 43446 - RNA, 19 nt, Homo sapiens
ugaugaugagcacucugga

SEQ ID NO: 43447 - RNA, 20 nt, Homo sapiens
uggggcaauucuaauggccu

SEQ ID NO: 43448 - RNA, 18 nt, Homo sapiens
uggguggggaauuaaaua

SEQ ID NO: 43449 - RNA, 18 nt, Homo sapiens
uuucugggggucaugggu

SEQ ID NO: 43450 - RNA, 18 nt, Homo sapiens
uuuuggaccguuucccag

SEQ ID NO: 43451 - RNA, 20 nt, Homo sapiens
aggaauguggcugggccuga

SEQ ID NO: 43452 - RNA, 23 nt, Homo sapiens
auccuuucccucucccccacccc

SEQ ID NO: 43453 - RNA, 16 nt, Homo sapiens
cacgugguugccuaug

SEQ ID NO: 43454 - RNA, 20 nt, Homo sapiens
cagcaccggcuucuuuaggc

SEQ ID NO: 43455 - RNA, 15 nt, Homo sapiens
ccucuuggggggccc

SEQ ID NO: 43456 - RNA, 16 nt, Homo sapiens
ccugagaaccaagccc

SEQ ID NO: 43457 - RNA, 19 nt, Homo sapiens
gaaugggaagaaaaaauga

SEQ ID NO: 43458 - RNA, 17 nt, Homo sapiens
gagaaaguuccggagag

SEQ ID NO: 43459 - RNA, 22 nt, Homo sapiens
gccugagaaccaagcccccucc

SEQ ID NO: 43460 - RNA, 19 nt, Homo sapiens
ggagacaacuucccacagg

SEQ ID NO: 43461 - RNA, 18 nt, Homo sapiens
gggaggggaaugggaaga

SEQ ID NO: 43462 - RNA, 16 nt, Homo sapiens
gucuaagaccacaggg

SEQ ID NO: 43463 - RNA, 19 nt, Homo sapiens
ucugggaaaagacuaggga

SEQ ID NO: 43464 - RNA, 18 nt, Homo sapiens
ugggaaaaagacguguca

SEQ ID NO: 43465 - RNA, 19 nt, Homo sapiens
ugggggucucuccaaaacc

SEQ ID NO: 43466 - RNA, 20 nt, Homo sapiens
uggugaggugggaguccuuc

SEQ ID NO: 43467 - RNA, 19 nt, Homo sapiens
uugaagagaagaaaagaga

SEQ ID NO: 43468 - RNA, 18 nt, Homo sapiens
ccaggccccaugaggucc

SEQ ID NO: 43469 - RNA, 23 nt, Homo sapiens
gggugagaaggagggggaggggc

SEQ ID NO: 43470 - RNA, 19 nt, Homo sapiens
ugagaaggagggggagggg

SEQ ID NO: 43471 - RNA, 17 nt, Homo sapiens
aaaaaaacucagcgaua

SEQ ID NO: 43472 - RNA, 18 nt, Homo sapiens
gacaggagaaucaauguc

SEQ ID NO: 43473 - RNA, 21 nt, Homo sapiens
uaaaaucugucacuguagcua

SEQ ID NO: 43474 - RNA, 18 nt, Homo sapiens
uggccaggauggucucga

SEQ ID NO: 43475 - RNA, 20 nt, Homo sapiens
aagauuguuguuuugggaaa

SEQ ID NO: 43476 - RNA, 18 nt, Homo sapiens
cccccgccccgccgggcc

SEQ ID NO: 43477 - RNA, 17 nt, Homo sapiens
guggcggcaacggccgc

SEQ ID NO: 43478 - RNA, 21 nt, Homo sapiens
guuaugccuaauugucaaaau

SEQ ID NO: 43479 - RNA, 19 nt, Homo sapiens
uauuacuaaacauugaaaa

SEQ ID NO: 43480 - RNA, 18 nt, Homo sapiens
uugaacauuucacuaaau

SEQ ID NO: 43481 - RNA, 20 nt, Homo sapiens
uuuaaacagaauucauagca

SEQ ID NO: 43482 - RNA, 20 nt, Homo sapiens
aagcggccgacccugagggc

SEQ ID NO: 43483 - RNA, 19 nt, Homo sapiens
aaguggaaggagagaggaa

SEQ ID NO: 43484 - RNA, 21 nt, Homo sapiens
accccgcccuugcuguuucuc

SEQ ID NO: 43485 - RNA, 21 nt, Homo sapiens
accucugccugugcaggcagc

SEQ ID NO: 43486 - RNA, 21 nt, Homo sapiens
acggggagggggcgcgcacgc

SEQ ID NO: 43487 - RNA, 18 nt, Homo sapiens
caguggcuuuggcuggcg

SEQ ID NO: 43488 - RNA, 19 nt, Homo sapiens
ccacgcugugcugcugccc

SEQ ID NO: 43489 - RNA, 21 nt, Homo sapiens
ccagcgggauucuuuguugca

SEQ ID NO: 43490 - RNA, 20 nt, Homo sapiens
ccaguuagaugguuccacua

SEQ ID NO: 43491 - RNA, 18 nt, Homo sapiens
ccgcuccucccgccgcgg

SEQ ID NO: 43492 - RNA, 18 nt, Homo sapiens
ccuugcuguuucucugag

SEQ ID NO: 43493 - RNA, 17 nt, Homo sapiens
cggcgccuucucggccg

SEQ ID NO: 43494 - RNA, 18 nt, Homo sapiens
cgggaggggccggggcga

SEQ ID NO: 43495 - RNA, 19 nt, Homo sapiens
cucccgccgcggcugccgg

SEQ ID NO: 43496 - RNA, 16 nt, Homo sapiens
gaaggagagaggaagu

SEQ ID NO: 43497 - RNA, 19 nt, Homo sapiens
gccgggcuccgggccaggc

SEQ ID NO: 43498 - RNA, 24 nt, Homo sapiens
gcuccgggccaggccuccgcgggg

SEQ ID NO: 43499 - RNA, 19 nt, Homo sapiens
ggacaguaaggacagagga

SEQ ID NO: 43500 - RNA, 21 nt, Homo sapiens
ggccuucucagcagcuggggc

SEQ ID NO: 43501 - RNA, 22 nt, Homo sapiens
gggcccgcgaugagcucgggag

SEQ ID NO: 43502 - RNA, 19 nt, Homo sapiens
gggcuguuccgcuccugcc

SEQ ID NO: 43503 - RNA, 22 nt, Homo sapiens
ggggcgcgcacgccgcucggcg

SEQ ID NO: 43504 - RNA, 15 nt, Homo sapiens
guggcaggacgggaa

SEQ ID NO: 43505 - RNA, 18 nt, Homo sapiens
uaaguggaaggagagagg

SEQ ID NO: 43506 - RNA, 17 nt, Homo sapiens
ucuuuguugcaaacugc

SEQ ID NO: 43507 - RNA, 16 nt, Homo sapiens
ugcagggucagcagca

SEQ ID NO: 43508 - RNA, 16 nt, Homo sapiens
agcggcuuacccacgc

SEQ ID NO: 43509 - RNA, 20 nt, Homo sapiens
cagccgcaccggggccaugu

SEQ ID NO: 43510 - RNA, 18 nt, Homo sapiens
cagcgcugguguggagga

SEQ ID NO: 43511 - RNA, 20 nt, Homo sapiens
cgcacacaugcacacacugc

SEQ ID NO: 43512 - RNA, 20 nt, Homo sapiens
cucucucgguggugcagugg

SEQ ID NO: 43513 - RNA, 22 nt, Homo sapiens
gaaaacucgcgggggagaagaa

SEQ ID NO: 43514 - RNA, 16 nt, Homo sapiens
gaacccgggaggcgga

SEQ ID NO: 43515 - RNA, 18 nt, Homo sapiens
guggucugggcagagucc

SEQ ID NO: 43516 - RNA, 17 nt, Homo sapiens
guguguguguaugugug

SEQ ID NO: 43517 - RNA, 21 nt, Homo sapiens
uaguauaucaaaagaagacug

SEQ ID NO: 43518 - RNA, 18 nt, Homo sapiens
ucgcgggggagaagaagu

SEQ ID NO: 43519 - RNA, 22 nt, Homo sapiens
ucucucgguggugcagugguuc

SEQ ID NO: 43520 - RNA, 19 nt, Homo sapiens
ugacuugaauaucuggaaa

SEQ ID NO: 43521 - RNA, 17 nt, Homo sapiens
ugcgcaggcuccagcag

SEQ ID NO: 43522 - RNA, 22 nt, Homo sapiens
uggugaaaaaaagcaagauaca

SEQ ID NO: 43523 - RNA, 17 nt, Homo sapiens
uucagaacuguauuuua

SEQ ID NO: 43524 - RNA, 23 nt, Homo sapiens
uucgugccucaugggagaaggga

SEQ ID NO: 43525 - RNA, 25 nt, Homo sapiens
cucgcaccagaggccccgcucuucg

SEQ ID NO: 43526 - RNA, 15 nt, Homo sapiens
gcgggggcggggccg

SEQ ID NO: 43527 - RNA, 14 nt, Homo sapiens
gggccaccaccggg

SEQ ID NO: 43528 - RNA, 28 nt, Homo sapiens
ucgcaccagaggccccgcucuucguucc

SEQ ID NO: 43529 - RNA, 28 nt, Homo sapiens
ccauccggccgccgcgcacucaccuccg

SEQ ID NO: 43530 - RNA, 18 nt, Homo sapiens
cggcguccuccacgcccg

SEQ ID NO: 43531 - RNA, 24 nt, Homo sapiens
cuggaagacaagaccggacugacg

SEQ ID NO: 43532 - RNA, 15 nt, Homo sapiens
gagcgcgcgccacgg

SEQ ID NO: 43533 - RNA, 17 nt, Homo sapiens
uccuccacgcccguccc

SEQ ID NO: 43534 - RNA, 22 nt, Homo sapiens
ugagcgcgcgccacggugcucg

SEQ ID NO: 43535 - RNA, 18 nt, Homo sapiens
ugaaauauuucuaauggu

SEQ ID NO: 43536 - RNA, 18 nt, Homo sapiens
acuucugggugcccuccu

SEQ ID NO: 43537 - RNA, 19 nt, Homo sapiens
ccuauggguccccuccucc

SEQ ID NO: 43538 - RNA, 19 nt, Homo sapiens
gaaagaaacuuuauuuuga

SEQ ID NO: 43539 - RNA, 20 nt, Homo sapiens
gcggaacucccgcggcgccg

SEQ ID NO: 43540 - RNA, 16 nt, Homo sapiens
gcuuggcuuuuauguc

SEQ ID NO: 43541 - RNA, 21 nt, Homo sapiens
aaagugaaguggcuacaaagg

SEQ ID NO: 43542 - RNA, 22 nt, Homo sapiens
aggaaaaucagacuucaaaguu

SEQ ID NO: 43543 - RNA, 23 nt, Homo sapiens
uuuacauauuccauuaauucuau

SEQ ID NO: 43544 - RNA, 20 nt, Homo sapiens
ggaggacagcgcgggcgagg

SEQ ID NO: 43545 - RNA, 20 nt, Homo sapiens
ucaggaaaugcuggggaugc

SEQ ID NO: 43546 - RNA, 20 nt, Homo sapiens
ugcuggggaugcaaacgugc

SEQ ID NO: 43547 - RNA, 22 nt, Homo sapiens
aaagucugggugaaggccuggg

SEQ ID NO: 43548 - RNA, 19 nt, Homo sapiens
aguggcugggagguuugga

SEQ ID NO: 43549 - RNA, 17 nt, Homo sapiens
aucaaggugacaugcag

SEQ ID NO: 43550 - RNA, 18 nt, Homo sapiens
cagccgggaccccgcccc

SEQ ID NO: 43551 - RNA, 19 nt, Homo sapiens
cuccucuuacuguucucug

SEQ ID NO: 43552 - RNA, 19 nt, Homo sapiens
gaggguguauggcucagug

SEQ ID NO: 43553 - RNA, 19 nt, Homo sapiens
gccugggcuccccuggccc

SEQ ID NO: 43554 - RNA, 20 nt, Homo sapiens
ggcacuggagguggaagucc

SEQ ID NO: 43555 - RNA, 14 nt, Homo sapiens
gggugggugagcac

SEQ ID NO: 43556 - RNA, 17 nt, Homo sapiens
ggcgguccuugcagcgc

SEQ ID NO: 43557 - RNA, 17 nt, Homo sapiens
ggggugggggacgcugg

SEQ ID NO: 43558 - RNA, 19 nt, Homo sapiens
acagcugggguccgcagag

SEQ ID NO: 43559 - RNA, 20 nt, Homo sapiens
aggcggcgggcaggcggccg

SEQ ID NO: 43560 - RNA, 17 nt, Homo sapiens
agggcguggggaggugg

SEQ ID NO: 43561 - RNA, 23 nt, Homo sapiens
ccugcagcaggggaggggagggc

SEQ ID NO: 43562 - RNA, 20 nt, Homo sapiens
cgggcgcacggaggaggcgg

SEQ ID NO: 43563 - RNA, 22 nt, Homo sapiens
cuagucccccuggcuaccugcc

SEQ ID NO: 43564 - RNA, 19 nt, Homo sapiens
cugaggcuggguguggugu

SEQ ID NO: 43565 - RNA, 23 nt, Homo sapiens
gaggggaggacugaggcugggug

SEQ ID NO: 43566 - RNA, 19 nt, Homo sapiens
gccucucuccucuccucuc

SEQ ID NO: 43567 - RNA, 15 nt, Homo sapiens
gcucacagcuggggc

SEQ ID NO: 43568 - RNA, 18 nt, Homo sapiens
ggagggcguggggaggug

SEQ ID NO: 43569 - RNA, 18 nt, Homo sapiens
ggcaggcggccggccgga

SEQ ID NO: 43570 - RNA, 16 nt, Homo sapiens
ggcgggcaggcggccg

SEQ ID NO: 43571 - RNA, 21 nt, Homo sapiens
gggagggcguggggagguggg

SEQ ID NO: 43572 - RNA, 20 nt, Homo sapiens
gggcuggggaggucugcggg

SEQ ID NO: 43573 - RNA, 18 nt, Homo sapiens
ggggagggcguggggagg

SEQ ID NO: 43574 - RNA, 15 nt, Homo sapiens
uggcuuucucucucc

SEQ ID NO: 43575 - RNA, 17 nt, Homo sapiens
aacagaugcaugcacac

SEQ ID NO: 43576 - RNA, 17 nt, Homo sapiens
aaucugggccucggccu

SEQ ID NO: 43577 - RNA, 15 nt, Homo sapiens
cacuguggugccuug

SEQ ID NO: 43578 - RNA, 19 nt, Homo sapiens
cauuuugccugcaaccauc

SEQ ID NO: 43579 - RNA, 18 nt, Homo sapiens
ccccugugcccugcuccc

SEQ ID NO: 43580 - RNA, 18 nt, Homo sapiens
cccuggcugggugucagc

SEQ ID NO: 43581 - RNA, 17 nt, Homo sapiens
ccucagggccaccugag

SEQ ID NO: 43582 - RNA, 21 nt, Homo sapiens
ccuucccacucucagauuugc

SEQ ID NO: 43583 - RNA, 18 nt, Homo sapiens
ggcaguccccaucccuga

SEQ ID NO: 43584 - RNA, 21 nt, Homo sapiens
gggaaggaggucuagggaggc

SEQ ID NO: 43585 - RNA, 18 nt, Homo sapiens
guaucuguguguacuucu

SEQ ID NO: 43586 - RNA, 14 nt, Homo sapiens
ucccacucucagau

SEQ ID NO: 43587 - RNA, 18 nt, Homo sapiens
uccccaucccugaguccc

SEQ ID NO: 43588 - RNA, 18 nt, Homo sapiens
ugaggagggagggaagga

SEQ ID NO: 43589 - RNA, 19 nt, Homo sapiens
uggaaacuuuuuagaucug

SEQ ID NO: 43590 - RNA, 21 nt, Homo sapiens
uuucuagugaaggugacauac

SEQ ID NO: 43591 - RNA, 18 nt, Homo sapiens
aacaugaaagguggucau

SEQ ID NO: 43592 - RNA, 21 nt, Homo sapiens
aauauauauauauauauauau

SEQ ID NO: 43593 - RNA, 24 nt, Homo sapiens
aauauauauauauauauauauaua

SEQ ID NO: 43594 - RNA, 23 nt, Homo sapiens
auaaauauauauauauauauaua

SEQ ID NO: 43595 - RNA, 19 nt, Homo sapiens
auauauauauauauauaua

SEQ ID NO: 43596 - RNA, 21 nt, Homo sapiens
auauauauauauauauauaua

SEQ ID NO: 43597 - RNA, 22 nt, Homo sapiens
auauauauauauauauauauau

SEQ ID NO: 43598 - RNA, 24 nt, Homo sapiens
auauauauauauauauauauauau

SEQ ID NO: 43599 - RNA, 19 nt, Homo sapiens
ccgugcauuucccaaaaag

SEQ ID NO: 43600 - RNA, 19 nt, Homo sapiens
cggaucuuuggaggaguuc

SEQ ID NO: 43601 - RNA, 21 nt, Homo sapiens
ggugucuuccucuccuuuccc

SEQ ID NO: 43602 - RNA, 25 nt, Homo sapiens
uaaauauauauauauauauauauau

SEQ ID NO: 43603 - RNA, 19 nt, Homo sapiens
uacaaaauacaaaugcccg

SEQ ID NO: 43604 - RNA, 22 nt, Homo sapiens
uauaaauauauauauauauaua

SEQ ID NO: 43605 - RNA, 22 nt, Homo sapiens
uauauaaauauauauauauaua

SEQ ID NO: 43606 - RNA, 22 nt, Homo sapiens
uauauauaaauauauauauaua

SEQ ID NO: 43607 - RNA, 24 nt, Homo sapiens
uauauauaaauauauauauauaua

SEQ ID NO: 43608 - RNA, 21 nt, Homo sapiens
uauauauauauauauauauau

SEQ ID NO: 43609 - RNA, 22 nt, Homo sapiens
uauauauauauauauauauaua

SEQ ID NO: 43610 - RNA, 24 nt, Human papillomavirus type 25
uauauauauauauauauauauaua

SEQ ID NO: 43611 - RNA, 25 nt, Homo sapiens
ugagucacugugucuggcgcccgug

SEQ ID NO: 43612 - RNA, 19 nt, Homo sapiens
uguguuuuggaaaaugaga

SEQ ID NO: 43613 - RNA, 20 nt, Homo sapiens
uguuuaaaggaaccuaggug

SEQ ID NO: 43614 - RNA, 19 nt, Homo sapiens
uuucaacagcacucuaccu

SEQ ID NO: 43615 - RNA, 17 nt, Homo sapiens
uuuguuagaauacugug

SEQ ID NO: 43616 - RNA, 19 nt, Homo sapiens
auauauauacauguacagc

SEQ ID NO: 43617 - RNA, 17 nt, Homo sapiens
augaagguccuuggcca

SEQ ID NO: 43618 - RNA, 24 nt, Homo sapiens
cauauauauauaugcauauauaua

SEQ ID NO: 43619 - RNA, 19 nt, Homo sapiens
cggcccgcaggucgggggg

SEQ ID NO: 43620 - RNA, 18 nt, Homo sapiens
cucagggucagcaggaag

SEQ ID NO: 43621 - RNA, 18 nt, Homo sapiens
cuugcccggcuacgggcu

SEQ ID NO: 43622 - RNA, 19 nt, Homo sapiens
gcaccccagaggcucucag

SEQ ID NO: 43623 - RNA, 18 nt, Homo sapiens
ggagucgguggcaacggg

SEQ ID NO: 43624 - RNA, 14 nt, Homo sapiens
ggcuucagggcugc

SEQ ID NO: 43625 - RNA, 21 nt, Homo sapiens
uauauauauaugcauauauau

SEQ ID NO: 43626 - RNA, 22 nt, Homo sapiens
uauauauauaugcauauauaua

SEQ ID NO: 43627 - RNA, 18 nt, Homo sapiens
uauauaugcauauauaua

SEQ ID NO: 43628 - RNA, 21 nt, Homo sapiens
uauauaugcauauauauacau

SEQ ID NO: 43629 - RNA, 20 nt, Homo sapiens
ucucugcgacccggggcccc

SEQ ID NO: 43630 - RNA, 24 nt, Homo sapiens
ucucuugcugagggcaagggugga

SEQ ID NO: 43631 - RNA, 19 nt, Homo sapiens
uucccacugccuucauuuu

SEQ ID NO: 43632 - RNA, 23 nt, Homo sapiens
acaggcucauuuuauccgagagc

SEQ ID NO: 43633 - RNA, 18 nt, Homo sapiens
caucgcccgccuuucccg

SEQ ID NO: 43634 - RNA, 18 nt, Homo sapiens
cgaugaggcccacgaggu

SEQ ID NO: 43635 - RNA, 19 nt, Homo sapiens
uagaaaaccacuacuuuau

SEQ ID NO: 43636 - RNA, 20 nt, Homo sapiens
ucgcucucgcuccuggcccg

SEQ ID NO: 43637 - RNA, 18 nt, Homo sapiens
ucucgcuccuggcccggc

SEQ ID NO: 43638 - RNA, 19 nt, Homo sapiens
ugcgagagucagccuuggc

SEQ ID NO: 43639 - RNA, 22 nt, Homo sapiens
aagauuguuucauagcacaaga

SEQ ID NO: 43640 - RNA, 23 nt, Homo sapiens
acauuaguaggugaaauguaagg

SEQ ID NO: 43641 - RNA, 17 nt, Homo sapiens
accagauaaaaaagaag

SEQ ID NO: 43642 - RNA, 17 nt, Homo sapiens
gauggugauuuuuguug

SEQ ID NO: 43643 - RNA, 21 nt, Homo sapiens
uccaugaauggaaauguguuu

SEQ ID NO: 43644 - RNA, 23 nt, Homo sapiens
acacagccaguaccccgcuuccc

SEQ ID NO: 43645 - RNA, 16 nt, Homo sapiens
cggcgcccgcccgucc

SEQ ID NO: 43646 - RNA, 18 nt, Homo sapiens
cgggggaacggagcgcuc

SEQ ID NO: 43647 - RNA, 19 nt, Homo sapiens
gcccgcccguccgaccgcc

SEQ ID NO: 43648 - RNA, 17 nt, Homo sapiens
uaaccaaugggacaagu

SEQ ID NO: 43649 - RNA, 18 nt, Homo sapiens
accucuugcagccgcucc

SEQ ID NO: 43650 - RNA, 18 nt, Homo sapiens
augaagauuaaugugguc

SEQ ID NO: 43651 - RNA, 16 nt, Homo sapiens
auuuuccacaccuccc

SEQ ID NO: 43652 - RNA, 18 nt, Homo sapiens
cauacagguugugcacgu

SEQ ID NO: 43653 - RNA, 19 nt, Homo sapiens
cccagacaaugucuccauc

SEQ ID NO: 43654 - RNA, 18 nt, Homo sapiens
cuuccacucuccucuugc

SEQ ID NO: 43655 - RNA, 18 nt, Homo sapiens
cuuugcccaucaucccag

SEQ ID NO: 43656 - RNA, 19 nt, Homo sapiens
gaacugacugucuaugucc

SEQ ID NO: 43657 - RNA, 22 nt, Homo sapiens
gagaggcgucccugcagccugg

SEQ ID NO: 43658 - RNA, 16 nt, Homo sapiens
gugcacguuguagugc

SEQ ID NO: 43659 - RNA, 19 nt, Homo sapiens
uguuugccuuuucuuugcu

SEQ ID NO: 43660 - RNA, 24 nt, Homo sapiens
uucacgaagcuugaugguucauuc

SEQ ID NO: 43661 - RNA, 18 nt, Homo sapiens
cgacgcguucuccagggc

SEQ ID NO: 43662 - RNA, 19 nt, Homo sapiens
uccauggggggaugauggg

SEQ ID NO: 43663 - RNA, 23 nt, Homo sapiens
agcggccggugcggcguggggcg

SEQ ID NO: 43664 - RNA, 17 nt, Homo sapiens
cguccccgcggcggccg

SEQ ID NO: 43665 - RNA, 18 nt, Homo sapiens
cugccgccuacccgagcu

SEQ ID NO: 43666 - RNA, 18 nt, Homo sapiens
gcgccggcgguucggagc

SEQ ID NO: 43667 - RNA, 20 nt, Homo sapiens
gggagcggccggugcggcgu

SEQ ID NO: 43668 - RNA, 23 nt, Homo sapiens
gggagcggccggugcggcguggg

SEQ ID NO: 43669 - RNA, 18 nt, Homo sapiens
ggggagcggccggugcgg

SEQ ID NO: 43670 - RNA, 19 nt, Homo sapiens
gguaagcagggguccaaga

SEQ ID NO: 43671 - RNA, 18 nt, Homo sapiens
uaaaaguugaaaaaauga

SEQ ID NO: 43672 - RNA, 20 nt, Homo sapiens
uacauauauauacaaauaua

SEQ ID NO: 43673 - RNA, 16 nt, Homo sapiens
ugagaauaacuuguuu

SEQ ID NO: 43674 - RNA, 22 nt, Homo sapiens
gccccggguuugggcuccgggg

SEQ ID NO: 43675 - RNA, 21 nt, Homo sapiens
gccgcccgggcacagcugccc

SEQ ID NO: 43676 - RNA, 18 nt, Homo sapiens
uggcaggcuugaagaaaa

SEQ ID NO: 43677 - RNA, 16 nt, Homo sapiens
cagaaggcaagcuccu

SEQ ID NO: 43678 - RNA, 17 nt, Homo sapiens
uaagaaaaagaccuucc

SEQ ID NO: 43679 - RNA, 18 nt, Homo sapiens
ucuuugguacaaagcuca

SEQ ID NO: 43680 - RNA, 18 nt, Homo sapiens
gcugcucuuaaacauuug

SEQ ID NO: 43681 - RNA, 19 nt, Homo sapiens
gugcaggcaccgggaugcu

SEQ ID NO: 43682 - RNA, 20 nt, Homo sapiens
cgccggaggaccugggucgc

SEQ ID NO: 43683 - RNA, 25 nt, Homo sapiens
cuccccguuccgccggaggaccugg

SEQ ID NO: 43684 - RNA, 22 nt, Homo sapiens
ggcccgacgcagggggaggugg

SEQ ID NO: 43685 - RNA, 16 nt, Homo sapiens
gggggaggugggggcg

SEQ ID NO: 43686 - RNA, 18 nt, Homo sapiens
uccccguuccgccggagg

SEQ ID NO: 43687 - RNA, 20 nt, Homo sapiens
aacacacauaagaaaguugg

SEQ ID NO: 43688 - RNA, 21 nt, Homo sapiens
ccucccucggagcuaccuguc

SEQ ID NO: 43689 - RNA, 23 nt, Homo sapiens
gaccugcagcagaucggcugugg

SEQ ID NO: 43690 - RNA, 19 nt, Homo sapiens
gcagcugcucacgacacag

SEQ ID NO: 43691 - RNA, 19 nt, Homo sapiens
uaaccuuaaucucaucuuc

SEQ ID NO: 43692 - RNA, 20 nt, Homo sapiens
uggcauugcuguucccugcc

SEQ ID NO: 43693 - RNA, 20 nt, Homo sapiens
ugucuccuguaugugggugu

SEQ ID NO: 43694 - RNA, 20 nt, Homo sapiens
aaaaaaagaaaaagaaaaac

SEQ ID NO: 43695 - RNA, 19 nt, Homo sapiens
acugcauuccagucugggu

SEQ ID NO: 43696 - RNA, 18 nt, Homo sapiens
agggacccaugaggaccu

SEQ ID NO: 43697 - RNA, 16 nt, Homo sapiens
caccccuggugaaaag

SEQ ID NO: 43698 - RNA, 22 nt, Homo sapiens
caggagaauggugucaaccugg

SEQ ID NO: 43699 - RNA, 19 nt, Homo sapiens
caggaucgacaugauucug

SEQ ID NO: 43700 - RNA, 21 nt, Homo sapiens
cagggcacuggacgcugcugc

SEQ ID NO: 43701 - RNA, 19 nt, Homo sapiens
cagggguugugaggguuug

SEQ ID NO: 43702 - RNA, 21 nt, Homo sapiens
cgacaugauucugaaggugau

SEQ ID NO: 43703 - RNA, 19 nt, Homo sapiens
cucccguugaucugacuuc

SEQ ID NO: 43704 - RNA, 20 nt, Homo sapiens
gaccucuauucuucuccgua

SEQ ID NO: 43705 - RNA, 20 nt, Homo sapiens
gagugacagaaauggugcgg

SEQ ID NO: 43706 - RNA, 21 nt, Homo sapiens
ggagggaaaaauucuguugac

SEQ ID NO: 43707 - RNA, 22 nt, Homo sapiens
ggagggugaggcaggagaaugg

SEQ ID NO: 43708 - RNA, 17 nt, Homo sapiens
ggccaggaguucgagac

SEQ ID NO: 43709 - RNA, 25 nt, Homo sapiens
aggcaggacugaggaagaguaauuu

SEQ ID NO: 43710 - RNA, 22 nt, Homo sapiens
aucacucuuguuuauaaaucac

SEQ ID NO: 43711 - RNA, 17 nt, Homo sapiens
caugugcagggaaugug

SEQ ID NO: 43712 - RNA, 18 nt, Homo sapiens
ccgccccuucccugcccc

SEQ ID NO: 43713 - RNA, 22 nt, Homo sapiens
cuacuccuacaaguuuuucugg

SEQ ID NO: 43714 - RNA, 18 nt, Homo sapiens
gaccugaaaagucccaau

SEQ ID NO: 43715 - RNA, 21 nt, Homo sapiens
gauagaucacucucucaccaa

SEQ ID NO: 43716 - RNA, 17 nt, Homo sapiens
gcgcccgcgcccgcgcc

SEQ ID NO: 43717 - RNA, 20 nt, Homo sapiens
ggcccagcccggcuacgggc

SEQ ID NO: 43718 - RNA, 19 nt, Homo sapiens
uaccagaagugcuuggaag

SEQ ID NO: 43719 - RNA, 23 nt, Homo sapiens
uauuuuaucacaguuacacuuga

SEQ ID NO: 43720 - RNA, 21 nt, Homo sapiens
uccaaccccgggggggggggc

SEQ ID NO: 43721 - RNA, 14 nt, Homo sapiens
uccagaauaggcgc

SEQ ID NO: 43722 - RNA, 20 nt, Homo sapiens
ucuuccauuuagcuagagac

SEQ ID NO: 43723 - RNA, 18 nt, Homo sapiens
uggaaucaccgcggcggc

SEQ ID NO: 43724 - RNA, 25 nt, Homo sapiens
uuaguuaugagaugcaauaaaugau

SEQ ID NO: 43725 - RNA, 16 nt, Homo sapiens
uuccaaccccgggggg

SEQ ID NO: 43726 - RNA, 23 nt, Homo sapiens
agcaguggucaaucugugcccug

SEQ ID NO: 43727 - RNA, 16 nt, Homo sapiens
agcggcggcggcagga

SEQ ID NO: 43728 - RNA, 17 nt, Homo sapiens
cccgcccccucugcucg

SEQ ID NO: 43729 - RNA, 20 nt, Homo sapiens
cccucugcucgcucucuggc

SEQ ID NO: 43730 - RNA, 17 nt, Homo sapiens
ccgcccccucugcucgc

SEQ ID NO: 43731 - RNA, 17 nt, Homo sapiens
ccgcccggccgccuccc

SEQ ID NO: 43732 - RNA, 18 nt, Homo sapiens
ccuuuguuuuggucgccc

SEQ ID NO: 43733 - RNA, 19 nt, Homo sapiens
gcaggcggaggcgcggcgg

SEQ ID NO: 43734 - RNA, 21 nt, Homo sapiens
ggaggagcagcggcggcggcg

SEQ ID NO: 43735 - RNA, 18 nt, Homo sapiens
ggcgggcaggcggaggcg

SEQ ID NO: 43736 - RNA, 18 nt, Homo sapiens
uagauugccuuguucugu

SEQ ID NO: 43737 - RNA, 21 nt, Homo sapiens
ucagugacucucaccagcaug

SEQ ID NO: 43738 - RNA, 15 nt, Homo sapiens
uuauuggaaugacuc

SEQ ID NO: 43739 - RNA, 19 nt, Homo sapiens
uuuguuagaagcaucagug

SEQ ID NO: 43740 - RNA, 18 nt, Homo sapiens
caucaucuaaauaaucau

SEQ ID NO: 43741 - RNA, 19 nt, Homo sapiens
gccaucccaucucuacacu

SEQ ID NO: 43742 - RNA, 18 nt, Homo sapiens
ucucugcccaccagcaga

SEQ ID NO: 43743 - RNA, 16 nt, Homo sapiens
accaagcgugcagucc

SEQ ID NO: 43744 - RNA, 20 nt, Homo sapiens
ccuccucccuccccuccucc

SEQ ID NO: 43745 - RNA, 18 nt, Homo sapiens
gcuucgggagccucgcgu

SEQ ID NO: 43746 - RNA, 18 nt, Homo sapiens
ggagcccugacggaaguu

SEQ ID NO: 43747 - RNA, 19 nt, Homo sapiens
ucuaagaaaaaaaaaagca

SEQ ID NO: 43748 - RNA, 16 nt, Homo sapiens
ucucccccucccaacg

SEQ ID NO: 43749 - RNA, 19 nt, Homo sapiens
ugaugggaguuacuauaac

SEQ ID NO: 43750 - RNA, 19 nt, Homo sapiens
aucuaugagaaacaagaag

SEQ ID NO: 43751 - RNA, 15 nt, Homo sapiens
cccaaguuucaucca

SEQ ID NO: 43752 - RNA, 17 nt, Homo sapiens
cccauacaaccuagccc

SEQ ID NO: 43753 - RNA, 19 nt, Homo sapiens
gagucuuaaaauguuucuu

SEQ ID NO: 43754 - RNA, 21 nt, Homo sapiens
guccuugcaccucagcccgag

SEQ ID NO: 43755 - RNA, 17 nt, Homo sapiens
uaauauagagauuuacu

SEQ ID NO: 43756 - RNA, 24 nt, Homo sapiens
ccguccguccccggcucccucccg

SEQ ID NO: 43757 - RNA, 17 nt, Homo sapiens
ccuccccccguccgucc

SEQ ID NO: 43758 - RNA, 18 nt, Homo sapiens
cggcucccucccgcccgc

SEQ ID NO: 43759 - RNA, 18 nt, Homo sapiens
gagagacgugagcaacag

SEQ ID NO: 43760 - RNA, 19 nt, Homo sapiens
gcgcgggggcggcccucgc

SEQ ID NO: 43761 - RNA, 21 nt, Homo sapiens
uccccggcucccucccgcccg

SEQ ID NO: 43762 - RNA, 18 nt, Homo sapiens
ugccccgccggccggcgc

SEQ ID NO: 43763 - RNA, 24 nt, Homo sapiens
aaaaaauucuucaaaccuuucaua

SEQ ID NO: 43764 - RNA, 20 nt, Homo sapiens
ggcaguuuuuuucuccaaug

SEQ ID NO: 43765 - RNA, 18 nt, Homo sapiens
ugaggccguuggcagccc

SEQ ID NO: 43766 - RNA, 18 nt, Homo sapiens
ugaguagaucauuguuuc

SEQ ID NO: 43767 - RNA, 19 nt, Homo sapiens
ugguuggauuuaggaccca

SEQ ID NO: 43768 - RNA, 21 nt, Homo sapiens
uugguuggauuuaggacccau

SEQ ID NO: 43769 - RNA, 20 nt, Homo sapiens
uuguuauauacaacacauaa

SEQ ID NO: 43770 - RNA, 21 nt, Homo sapiens
aggcaggcgcuggcugcuuga

SEQ ID NO: 43771 - RNA, 15 nt, Homo sapiens
cccugaagaaccuga

SEQ ID NO: 43772 - RNA, 15 nt, Homo sapiens
uggguggggaggggg

SEQ ID NO: 43773 - RNA, 16 nt, Homo sapiens
aagcaggagccaccuc

SEQ ID NO: 43774 - RNA, 20 nt, Homo sapiens
aguggagggugggggccuga

SEQ ID NO: 43775 - RNA, 17 nt, Homo sapiens
ccaggcuggcugucagc

SEQ ID NO: 43776 - RNA, 21 nt, Homo sapiens
ccuaggauuccagggucccag

SEQ ID NO: 43777 - RNA, 23 nt, Homo sapiens
ccugggggccgcggugcgcccgc

SEQ ID NO: 43778 - RNA, 18 nt, Homo sapiens
gagccuucgggagcugag

SEQ ID NO: 43779 - RNA, 18 nt, Homo sapiens
gcguguccugggggccgc

SEQ ID NO: 43780 - RNA, 22 nt, Homo sapiens
ggagggugggggccugaggugg

SEQ ID NO: 43781 - RNA, 18 nt, Homo sapiens
gggaggaguggagggugg

SEQ ID NO: 43782 - RNA, 18 nt, Homo sapiens
gggagggaguggaggaag

SEQ ID NO: 43783 - RNA, 16 nt, Homo sapiens
ggggaggaggguagag

SEQ ID NO: 43784 - RNA, 19 nt, Homo sapiens
ggggaggaguggagggugg

SEQ ID NO: 43785 - RNA, 18 nt, Homo sapiens
gguggacaggcaggagcc

SEQ ID NO: 43786 - RNA, 22 nt, Homo sapiens
uagggcugauggaaagaguggg

SEQ ID NO: 43787 - RNA, 17 nt, Homo sapiens
ucagaggggaaaaagau

SEQ ID NO: 43788 - RNA, 19 nt, Homo sapiens
cuaaaacucuccuuucucu

SEQ ID NO: 43789 - RNA, 16 nt, Homo sapiens
aagcaccccagagagg

SEQ ID NO: 43790 - RNA, 20 nt, Homo sapiens
aauacugggggauauuauuc

SEQ ID NO: 43791 - RNA, 17 nt, Homo sapiens
aaugaguucucuuaagc

SEQ ID NO: 43792 - RNA, 21 nt, Homo sapiens
acuucaaacuaaaggcuuucc

SEQ ID NO: 43793 - RNA, 14 nt, Homo sapiens
agagaaaacagggg

SEQ ID NO: 43794 - RNA, 19 nt, Homo sapiens
aucccaaauaugguugguc

SEQ ID NO: 43795 - RNA, 17 nt, Homo sapiens
cacacuuucaaugggaa

SEQ ID NO: 43796 - RNA, 19 nt, Homo sapiens
cacggauggauuugugccu

SEQ ID NO: 43797 - RNA, 18 nt, Homo sapiens
ccacguucgcgcgcugcc

SEQ ID NO: 43798 - RNA, 20 nt, Homo sapiens
cccgaagacaggugcgggac

SEQ ID NO: 43799 - RNA, 18 nt, Homo sapiens
gaaaaagaaaucaaaaga

SEQ ID NO: 43800 - RNA, 19 nt, Homo sapiens
gacaauaauccccagcacg

SEQ ID NO: 43801 - RNA, 16 nt, Homo sapiens
gcgggggcaggacccg

SEQ ID NO: 43802 - RNA, 18 nt, Homo sapiens
ggagagcaggaggcugau

SEQ ID NO: 43803 - RNA, 16 nt, Homo sapiens
ggccccguccacgccc

SEQ ID NO: 43804 - RNA, 17 nt, Homo sapiens
uaccccacugauaucag

SEQ ID NO: 43805 - RNA, 16 nt, Homo sapiens
ucuguguagaauccag

SEQ ID NO: 43806 - RNA, 15 nt, Homo sapiens
uuuacaaaaacacag

SEQ ID NO: 43807 - RNA, 15 nt, Homo sapiens
uuuagcuggucaagu

SEQ ID NO: 43808 - RNA, 23 nt, Homo sapiens
acgcugggcagcacugugggcuc

SEQ ID NO: 43809 - RNA, 16 nt, Homo sapiens
cagucaggaagcuccu

SEQ ID NO: 43810 - RNA, 15 nt, Homo sapiens
ccagacugagggagc

SEQ ID NO: 43811 - RNA, 19 nt, Homo sapiens
ccgggcuggcaugggaagc

SEQ ID NO: 43812 - RNA, 18 nt, Homo sapiens
cggcaccucucccgaggc

SEQ ID NO: 43813 - RNA, 24 nt, Homo sapiens
ucuccggcugcaugauagagaagu

SEQ ID NO: 43814 - RNA, 16 nt, Homo sapiens
acgcaguguccuaacu

SEQ ID NO: 43815 - RNA, 15 nt, Homo sapiens
guagaggugguggga

SEQ ID NO: 43816 - RNA, 21 nt, Homo sapiens
ugaaauaaauacaaaccaguu

SEQ ID NO: 43817 - RNA, 25 nt, Homo sapiens
cuucccauguuuccaaaguuauuua

SEQ ID NO: 43818 - RNA, 21 nt, Homo sapiens
uagagauagacaguauuucag

SEQ ID NO: 43819 - RNA, 18 nt, Homo sapiens
agacuccgcuccucucag

SEQ ID NO: 43820 - RNA, 18 nt, Homo sapiens
agccaagauguugcaaau

SEQ ID NO: 43821 - RNA, 24 nt, Homo sapiens
aggaaaagaaaggauaaaugaaga

SEQ ID NO: 43822 - RNA, 17 nt, Homo sapiens
cuccugcugaggcagug

SEQ ID NO: 43823 - RNA, 19 nt, Homo sapiens
uaacagaguauucucugau

SEQ ID NO: 43824 - RNA, 16 nt, Homo sapiens
ucagguucuucugagu

SEQ ID NO: 43825 - RNA, 20 nt, Homo sapiens
ucauucuaacauucacaugu

SEQ ID NO: 43826 - RNA, 18 nt, Homo sapiens
ucucccagccgccgcugc

SEQ ID NO: 43827 - RNA, 18 nt, Homo sapiens
uguaggaaaagaaaggau

SEQ ID NO: 43828 - RNA, 17 nt, Homo sapiens
ccagagaggagacgugu

SEQ ID NO: 43829 - RNA, 17 nt, Homo sapiens
ccgccgccacggccgcc

SEQ ID NO: 43830 - RNA, 18 nt, Homo sapiens
ccgccgcccgcgcucccg

SEQ ID NO: 43831 - RNA, 23 nt, Homo sapiens
ccuugaggacgccgucucuagcc

SEQ ID NO: 43832 - RNA, 15 nt, Homo sapiens
caccgcugccgcccc

SEQ ID NO: 43833 - RNA, 18 nt, Homo sapiens
ccguccucuccugccccc

SEQ ID NO: 43834 - RNA, 21 nt, Homo sapiens
gacauuuggucucugguuugu

SEQ ID NO: 43835 - RNA, 18 nt, Homo sapiens
gagcuggggucugucccc

SEQ ID NO: 43836 - RNA, 21 nt, Homo sapiens
gaggccguuuacacugcucuc

SEQ ID NO: 43837 - RNA, 22 nt, Homo sapiens
gcacuggagcggccccggcggc

SEQ ID NO: 43838 - RNA, 19 nt, Homo sapiens
uaaaugaaacagaccugga

SEQ ID NO: 43839 - RNA, 15 nt, Homo sapiens
uggaagcucaggggc

SEQ ID NO: 43840 - RNA, 16 nt, Homo sapiens
cggcggccccgcccga

SEQ ID NO: 43841 - RNA, 16 nt, Homo sapiens
cuuugacagggagggg

SEQ ID NO: 43842 - RNA, 19 nt, Homo sapiens
gaggcagguccaggcccca

SEQ ID NO: 43843 - RNA, 19 nt, Homo sapiens
gcggccccgcccgaggccc

SEQ ID NO: 43844 - RNA, 18 nt, Homo sapiens
gcggguggggaggagaag

SEQ ID NO: 43845 - RNA, 18 nt, Homo sapiens
ggucccgaggccccgugg

SEQ ID NO: 43846 - RNA, 20 nt, Homo sapiens
gucagggagguggcaggggc

SEQ ID NO: 43847 - RNA, 20 nt, Homo sapiens
uccauuuucuaacagucugg

SEQ ID NO: 43848 - RNA, 19 nt, Homo sapiens
uccuccccucccaccgccc

SEQ ID NO: 43849 - RNA, 18 nt, Homo sapiens
aggagcaggagaaacaaa

SEQ ID NO: 43850 - RNA, 16 nt, Homo sapiens
cggcggaggcgggggg

SEQ ID NO: 43851 - RNA, 18 nt, Homo sapiens
gccucggccgcgggcgcc

SEQ ID NO: 43852 - RNA, 24 nt, Homo sapiens
gcucuuugucuucuucuccaaggc

SEQ ID NO: 43853 - RNA, 16 nt, Homo sapiens
gggacccggccggccu

SEQ ID NO: 43854 - RNA, 21 nt, Homo sapiens
ggggcuacgacggcgguggcc

SEQ ID NO: 43855 - RNA, 21 nt, Homo sapiens
uacuccauucuccccucuccc

SEQ ID NO: 43856 - RNA, 20 nt, Homo sapiens
acagagcuaacuugugcaga

SEQ ID NO: 43857 - RNA, 20 nt, Homo sapiens
acuggcuagaagugcaguca

SEQ ID NO: 43858 - RNA, 21 nt, Homo sapiens
agcaguggaaggcauuggucu

SEQ ID NO: 43859 - RNA, 19 nt, Homo sapiens
gaaggcauuggucugaacu

SEQ ID NO: 43860 - RNA, 19 nt, Homo sapiens
gugcuccggaauccggugc

SEQ ID NO: 43861 - RNA, 18 nt, Homo sapiens
uccuccugguccugagca

SEQ ID NO: 43862 - RNA, 21 nt, Homo sapiens
ugagcacuuguuguauucuca

SEQ ID NO: 43863 - RNA, 23 nt, Homo sapiens
agugauuaaaggacacaaggccu

SEQ ID NO: 43864 - RNA, 22 nt, Homo sapiens
uggggaugguggcuucgggagg

SEQ ID NO: 43865 - RNA, 21 nt, Homo sapiens
agggguugugggaugagaccu

SEQ ID NO: 43866 - RNA, 21 nt, Homo sapiens
ccccagagcucugaccucggu

SEQ ID NO: 43867 - RNA, 22 nt, Homo sapiens
cgccuccagcagcgcgcggguc

SEQ ID NO: 43868 - RNA, 16 nt, Homo sapiens
gguucugguggccauc

SEQ ID NO: 43869 - RNA, 17 nt, Homo sapiens
gugugugggugggugug

SEQ ID NO: 43870 - RNA, 18 nt, Homo sapiens
uacagugcuugggagaga

SEQ ID NO: 43871 - RNA, 15 nt, Homo sapiens
aagcaccccaggagg

SEQ ID NO: 43872 - RNA, 22 nt, Homo sapiens
aagggacgguugaguguggugg

SEQ ID NO: 43873 - RNA, 24 nt, Homo sapiens
cagcggugaagaaucgugggggaa

SEQ ID NO: 43874 - RNA, 17 nt, Homo sapiens
cauucggggggagccac

SEQ ID NO: 43875 - RNA, 17 nt, Homo sapiens
gaggggcaggaggcggc

SEQ ID NO: 43876 - RNA, 19 nt, Homo sapiens
gagugugguggugagcagc

SEQ ID NO: 43877 - RNA, 19 nt, Homo sapiens
guugggccacacagcccug

SEQ ID NO: 43878 - RNA, 16 nt, Homo sapiens
cagccgccucacaccc

SEQ ID NO: 43879 - RNA, 17 nt, Homo sapiens
ccuguucccagcguggc

SEQ ID NO: 43880 - RNA, 26 nt, Homo sapiens
cgcgucgccauggagcccgacgggac

SEQ ID NO: 43881 - RNA, 18 nt, Homo sapiens
cguggccccgcccugccc

SEQ ID NO: 43882 - RNA, 15 nt, Homo sapiens
gacgggacuuacgag

SEQ ID NO: 43883 - RNA, 23 nt, Homo sapiens
gcuucguggguauucgcuucugc

SEQ ID NO: 43884 - RNA, 19 nt, Homo sapiens
uacgagccgggcuucgugg

SEQ ID NO: 43885 - RNA, 25 nt, Homo sapiens
ucguggguauucgcuucugccgcag

SEQ ID NO: 43886 - RNA, 15 nt, Homo sapiens
ugggccagcccagcc

SEQ ID NO: 43887 - RNA, 24 nt, Homo sapiens
uguagcgcggcggagcaagcgcgg

SEQ ID NO: 43888 - RNA, 19 nt, Homo sapiens
uuggcgaagcaccuaggcc

SEQ ID NO: 43889 - RNA, 19 nt, Homo sapiens
agcuggugcggggcucugg

SEQ ID NO: 43890 - RNA, 17 nt, Homo sapiens
agguaaggucauuuggu

SEQ ID NO: 43891 - RNA, 20 nt, Homo sapiens
caauuucuguggcucauccu

SEQ ID NO: 43892 - RNA, 16 nt, Homo sapiens
cacacuuuggcaagag

SEQ ID NO: 43893 - RNA, 21 nt, Homo sapiens
caucacaguacuaacccucug

SEQ ID NO: 43894 - RNA, 19 nt, Homo sapiens
gcuguucgugaagaugucc

SEQ ID NO: 43895 - RNA, 22 nt, Homo sapiens
ggaggcacuuguagcugaguga

SEQ ID NO: 43896 - RNA, 22 nt, Homo sapiens
uaauuuacaauuaacauuacag

SEQ ID NO: 43897 - RNA, 21 nt, Homo sapiens
uagaacaaauagucacuuugc

SEQ ID NO: 43898 - RNA, 23 nt, Homo sapiens
ucauguaucaggaagacuugaaa

SEQ ID NO: 43899 - RNA, 18 nt, Homo sapiens
ucccgcagaugugccauu

SEQ ID NO: 43900 - RNA, 18 nt, Homo sapiens
uccuugucuguaauuugu

SEQ ID NO: 43901 - RNA, 16 nt, Homo sapiens
ucuacauuauugugaa

SEQ ID NO: 43902 - RNA, 19 nt, Homo sapiens
uguauugguguuuguuaau

SEQ ID NO: 43903 - RNA, 16 nt, Homo sapiens
uuaaggcugacguggg

SEQ ID NO: 43904 - RNA, 19 nt, Homo sapiens
uugacauauuuguugcuuc

SEQ ID NO: 43905 - RNA, 19 nt, Homo sapiens
uugcuucagacaacacgaa

SEQ ID NO: 43906 - RNA, 18 nt, Homo sapiens
uuucuagacuucacucag

SEQ ID NO: 43907 - RNA, 17 nt, Homo sapiens
cggccccgccccggccc

SEQ ID NO: 43908 - RNA, 19 nt, Homo sapiens
cggggaggggaagcucuuc

SEQ ID NO: 43909 - RNA, 24 nt, Homo sapiens
gaggcuaccgcagggccccgcgcc

SEQ ID NO: 43910 - RNA, 21 nt, Homo sapiens
gcuguggcuuucucucuccug

SEQ ID NO: 43911 - RNA, 22 nt, Homo sapiens
ggagaaagggugaaacuaggag

SEQ ID NO: 43912 - RNA, 18 nt, Homo sapiens
ggcugcuggucggggagg

SEQ ID NO: 43913 - RNA, 23 nt, Homo sapiens
gucaaaguuagccugguacauga

SEQ ID NO: 43914 - RNA, 19 nt, Homo sapiens
ucaaaguuagccugguaca

SEQ ID NO: 43915 - RNA, 20 nt, Homo sapiens
uccaguuggauccuauggca

SEQ ID NO: 43916 - RNA, 15 nt, Homo sapiens
ugcacaggccccgcc

SEQ ID NO: 43917 - RNA, 21 nt, Homo sapiens
aggcagaucgucuccaaugac

SEQ ID NO: 43918 - RNA, 19 nt, Homo sapiens
guggugcuucaaguucuag

SEQ ID NO: 43919 - RNA, 17 nt, Homo sapiens
ucuguugaaacagauuu

SEQ ID NO: 43920 - RNA, 24 nt, Homo sapiens
uugaaacagauuucuuuuuuaaca

SEQ ID NO: 43921 - RNA, 18 nt, Homo sapiens
aggccagccugggggcca

SEQ ID NO: 43922 - RNA, 24 nt, Homo sapiens
augccgcuggugugccagcucaua

SEQ ID NO: 43923 - RNA, 17 nt, Homo sapiens
cagguuccuuggaggcc

SEQ ID NO: 43924 - RNA, 20 nt, Homo sapiens
ccuuggaggccgagggcagc

SEQ ID NO: 43925 - RNA, 17 nt, Homo sapiens
gccagccugggggccac

SEQ ID NO: 43926 - RNA, 21 nt, Homo sapiens
ggcagcccugguguacacaug

SEQ ID NO: 43927 - RNA, 20 nt, Homo sapiens
gguugucagguuccuuggag

SEQ ID NO: 43928 - RNA, 17 nt, Homo sapiens
ugugccagcucauagcc

SEQ ID NO: 43929 - RNA, 20 nt, Homo sapiens
uguuggccacgaaagacagg

SEQ ID NO: 43930 - RNA, 18 nt, Homo sapiens
acagacagacaugggccg

SEQ ID NO: 43931 - RNA, 14 nt, Homo sapiens
ccccaccccuccgg

SEQ ID NO: 43932 - RNA, 18 nt, Homo sapiens
ccgcccgccgccgccucg

SEQ ID NO: 43933 - RNA, 17 nt, Homo sapiens
ccuccaccuccucgccg

SEQ ID NO: 43934 - RNA, 19 nt, Homo sapiens
cgccguccccaccccuccg

SEQ ID NO: 43935 - RNA, 20 nt, Homo sapiens
gagguagggccaggcccugg

SEQ ID NO: 43936 - RNA, 18 nt, Homo sapiens
ggggagaggagaaggggc

SEQ ID NO: 43937 - RNA, 19 nt, Homo sapiens
ucagaagugugaguccugg

SEQ ID NO: 43938 - RNA, 23 nt, Homo sapiens
ugccuguaaucucagcacuuugg

SEQ ID NO: 43939 - RNA, 24 nt, Homo sapiens
agaaagacagaaggcgaaggagac

SEQ ID NO: 43940 - RNA, 18 nt, Homo sapiens
ggguacaggggugggggu

SEQ ID NO: 43941 - RNA, 18 nt, Homo sapiens
guaggcucagcccagaga

SEQ ID NO: 43942 - RNA, 20 nt, Homo sapiens
ucauuauauauauauuuaca

SEQ ID NO: 43943 - RNA, 17 nt, Homo sapiens
ucccgggucagccccag

SEQ ID NO: 43944 - RNA, 21 nt, Homo sapiens
uuauuuaaggggauauauauc

SEQ ID NO: 43945 - RNA, 22 nt, Homo sapiens
uuuccauguguaccuuuauuua

SEQ ID NO: 43946 - RNA, 16 nt, Homo sapiens
cccacccucccgcuag

SEQ ID NO: 43947 - RNA, 21 nt, Homo sapiens
cccgccguccccacccucccg

SEQ ID NO: 43948 - RNA, 19 nt, Homo sapiens
cgauauuucuggugaccca

SEQ ID NO: 43949 - RNA, 16 nt, Homo sapiens
cguucgggcgcgcuuc

SEQ ID NO: 43950 - RNA, 17 nt, Homo sapiens
gccccggcggcggagcc

SEQ ID NO: 43951 - RNA, 19 nt, Homo sapiens
gcccggccccggcggcgga

SEQ ID NO: 43952 - RNA, 21 nt, Homo sapiens
gcccugagcagcggagccgug

SEQ ID NO: 43953 - RNA, 20 nt, Homo sapiens
gccgcccuccccgccguccc

SEQ ID NO: 43954 - RNA, 19 nt, Homo sapiens
gccgugccccgcgcccgcc

SEQ ID NO: 43955 - RNA, 16 nt, Homo sapiens
ggcuaaggaccgggca

SEQ ID NO: 43956 - RNA, 14 nt, Homo sapiens
aagggaaaggaugg

SEQ ID NO: 43957 - RNA, 18 nt, Homo sapiens
agagggaggggaaauaga

SEQ ID NO: 43958 - RNA, 17 nt, Homo sapiens
cauucuuggaaucagga

SEQ ID NO: 43959 - RNA, 16 nt, Homo sapiens
gcucgcucaagucccu

SEQ ID NO: 43960 - RNA, 19 nt, Homo sapiens
ggcggagccuuuccuuccc

SEQ ID NO: 43961 - RNA, 18 nt, Homo sapiens
guacacacaguuucauua

SEQ ID NO: 43962 - RNA, 18 nt, Homo sapiens
uucuuucauuuucucucu

SEQ ID NO: 43963 - RNA, 20 nt, Homo sapiens
aaguagccugguccuggggu

SEQ ID NO: 43964 - RNA, 21 nt, Homo sapiens
agaggaaacauggucacaccc

SEQ ID NO: 43965 - RNA, 20 nt, Homo sapiens
cccuuuggagcaagaacagc

SEQ ID NO: 43966 - RNA, 21 nt, Homo sapiens
ccucagcucugccagucccuc

SEQ ID NO: 43967 - RNA, 21 nt, Homo sapiens
gaggaagcgggugcggagagc

SEQ ID NO: 43968 - RNA, 19 nt, Homo sapiens
gcggagagcaggggugggg

SEQ ID NO: 43969 - RNA, 17 nt, Homo sapiens
gcuuucccucaaucucg

SEQ ID NO: 43970 - RNA, 15 nt, Homo sapiens
ggugcgcucaacagc

SEQ ID NO: 43971 - RNA, 19 nt, Homo sapiens
aagcagagggcagugggaa

SEQ ID NO: 43972 - RNA, 22 nt, Homo sapiens
aaguugcugucugagacccaug

SEQ ID NO: 43973 - RNA, 19 nt, Homo sapiens
aauuucgcagguuggucca

SEQ ID NO: 43974 - RNA, 14 nt, Homo sapiens
agaggggagugugc

SEQ ID NO: 43975 - RNA, 23 nt, Homo sapiens
aggcaagagcaaacaccaaugac

SEQ ID NO: 43976 - RNA, 20 nt, Homo sapiens
ccccaccccaccucucuucc

SEQ ID NO: 43977 - RNA, 21 nt, Homo sapiens
ccuaagaacgguacggacugc

SEQ ID NO: 43978 - RNA, 16 nt, Homo sapiens
cuaguuaaauaggaag

SEQ ID NO: 43979 - RNA, 22 nt, Homo sapiens
cugaagagagaccuuguaaaau

SEQ ID NO: 43980 - RNA, 19 nt, Homo sapiens
gaacuacagaaaauaauaa

SEQ ID NO: 43981 - RNA, 16 nt, Homo sapiens
gagcaacagaacaggc

SEQ ID NO: 43982 - RNA, 18 nt, Homo sapiens
gagugugcuggagagagg

SEQ ID NO: 43983 - RNA, 17 nt, Homo sapiens
gauuucccacaaagcac

SEQ ID NO: 43984 - RNA, 18 nt, Homo sapiens
ggauggacacugaucaag

SEQ ID NO: 43985 - RNA, 18 nt, Homo sapiens
uaugugugugugugugug

SEQ ID NO: 43986 - RNA, 17 nt, Homo sapiens
ucugguccugauacucc

SEQ ID NO: 43987 - RNA, 19 nt, Homo sapiens
ugccaugagggguggagca

SEQ ID NO: 43988 - RNA, 22 nt, Homo sapiens
uguguaaaaugugugugugugu

SEQ ID NO: 43989 - RNA, 24 nt, Homo sapiens
uguguguaaaaugugugugugugu

SEQ ID NO: 43990 - RNA, 18 nt, Homo sapiens
ugugugugugugugugug

SEQ ID NO: 43991 - RNA, 19 nt, Homo sapiens
ugugugugugugugugugu

SEQ ID NO: 43992 - RNA, 18 nt, Homo sapiens
uuaauuguccuuguuugc

SEQ ID NO: 43993 - RNA, 15 nt, Homo sapiens
uuguuugcagugagc

SEQ ID NO: 43994 - RNA, 25 nt, Homo sapiens
uuugcauaaaugaaaacugguuuua

SEQ ID NO: 43995 - RNA, 24 nt, Homo sapiens
uuuggauuuuccccaauccaacau

SEQ ID NO: 43996 - RNA, 20 nt, Homo sapiens
cggcggcgguggggcugcuc

SEQ ID NO: 43997 - RNA, 14 nt, Homo sapiens
gccggcggcggcgg

SEQ ID NO: 43998 - RNA, 16 nt, Homo sapiens
ggcaaaaagcaagcac

SEQ ID NO: 43999 - RNA, 18 nt, Homo sapiens
ggcggcgguggggcugcu

SEQ ID NO: 44000 - RNA, 24 nt, Homo sapiens
acaaaaauauuuaacagaacuaug

SEQ ID NO: 44001 - RNA, 18 nt, Homo sapiens
agacgccgcgcagcccgg

SEQ ID NO: 44002 - RNA, 18 nt, Homo sapiens
cgaggagggucacagccg

SEQ ID NO: 44003 - RNA, 16 nt, Homo sapiens
cggccgcaaccggagc

SEQ ID NO: 44004 - RNA, 18 nt, Homo sapiens
gccuggucucggcggcgc

SEQ ID NO: 44005 - RNA, 18 nt, Homo sapiens
ggcggccgcggagggcgg

SEQ ID NO: 44006 - RNA, 23 nt, Homo sapiens
uaccauaaaacauuuuuuuuucu

SEQ ID NO: 44007 - RNA, 22 nt, Homo sapiens
caacagaaacccccuguccaga

SEQ ID NO: 44008 - RNA, 15 nt, Homo sapiens
cauccagcaacugug

SEQ ID NO: 44009 - RNA, 20 nt, Homo sapiens
ccaggcggugggcgagcagc

SEQ ID NO: 44010 - RNA, 16 nt, Homo sapiens
gcugugggcgcacccc

SEQ ID NO: 44011 - RNA, 16 nt, Homo sapiens
ucggcucuuccaggcg

SEQ ID NO: 44012 - RNA, 21 nt, Homo sapiens
agaggaagaauggaggauugg

SEQ ID NO: 44013 - RNA, 22 nt, Homo sapiens
ggagugcauguggcggcaguuu

SEQ ID NO: 44014 - RNA, 15 nt, Homo sapiens
ggcacaggcccugug

SEQ ID NO: 44015 - RNA, 22 nt, Homo sapiens
ugaaacaaguuaguauaggaga

SEQ ID NO: 44016 - RNA, 18 nt, Homo sapiens
agguaggaagggaagggg

SEQ ID NO: 44017 - RNA, 18 nt, Homo sapiens
caagagcagcuuguggcu

SEQ ID NO: 44018 - RNA, 15 nt, Homo sapiens
ccacuagccaccucc

SEQ ID NO: 44019 - RNA, 20 nt, Homo sapiens
cccguucccgccggcggccg

SEQ ID NO: 44020 - RNA, 18 nt, Homo sapiens
ccgccgcccagacuccgc

SEQ ID NO: 44021 - RNA, 19 nt, Homo sapiens
ccgccgucccgccucagcc

SEQ ID NO: 44022 - RNA, 17 nt, Homo sapiens
ggagcuuaaauggaagu

SEQ ID NO: 44023 - RNA, 18 nt, Homo sapiens
uuaguaguagagcuagag

SEQ ID NO: 44024 - RNA, 21 nt, Homo sapiens
acauccccugauaacugugaa

SEQ ID NO: 44025 - RNA, 15 nt, Homo sapiens
aggcggcggccgagg

SEQ ID NO: 44026 - RNA, 25 nt, Homo sapiens
agggggcugcggugugggggcgcgu

SEQ ID NO: 44027 - RNA, 19 nt, Homo sapiens
cagcgcaggcuccguggaa

SEQ ID NO: 44028 - RNA, 21 nt, Homo sapiens
cagcgccacccgcccggcagc

SEQ ID NO: 44029 - RNA, 16 nt, Homo sapiens
ccacacguggcaaggg

SEQ ID NO: 44030 - RNA, 15 nt, Homo sapiens
ccagccgcccagccc

SEQ ID NO: 44031 - RNA, 19 nt, Homo sapiens
ccagugggcaaagcacagc

SEQ ID NO: 44032 - RNA, 15 nt, Homo sapiens
ccccaccuuccgagu

SEQ ID NO: 44033 - RNA, 23 nt, Homo sapiens
cccccggcccggcccuggccgga

SEQ ID NO: 44034 - RNA, 19 nt, Homo sapiens
ccgcccgccgcggcccucc

SEQ ID NO: 44035 - RNA, 19 nt, Homo sapiens
ccgccgcggcccuccggcc

SEQ ID NO: 44036 - RNA, 22 nt, Homo sapiens
ccgccugcccgccgccgccccc

SEQ ID NO: 44037 - RNA, 21 nt, Homo sapiens
ccggccccggccgacgcggcc

SEQ ID NO: 44038 - RNA, 14 nt, Homo sapiens
ccguugacaaaagg

SEQ ID NO: 44039 - RNA, 18 nt, Homo sapiens
ccugcccgccgccgcccc

SEQ ID NO: 44040 - RNA, 18 nt, Homo sapiens
cgaccgagggagcccccc

SEQ ID NO: 44041 - RNA, 21 nt, Homo sapiens
cgugggguuggaaggacagcc

SEQ ID NO: 44042 - RNA, 22 nt, Homo sapiens
gaaauaaaaaccauuuguuaaa

SEQ ID NO: 44043 - RNA, 20 nt, Homo sapiens
gccaugagagagggcccagg

SEQ ID NO: 44044 - RNA, 18 nt, Homo sapiens
gccgcggcccuccggccc

SEQ ID NO: 44045 - RNA, 21 nt, Homo sapiens
gccggagccgccucggccgcc

SEQ ID NO: 44046 - RNA, 21 nt, Homo sapiens
ggacccggcggcucgccaggc

SEQ ID NO: 44047 - RNA, 29 nt, Homo sapiens
ggcagccccaagcagccaguguuggcccg

SEQ ID NO: 44048 - RNA, 18 nt, Homo sapiens
ggcggccgaggcggggcg

SEQ ID NO: 44049 - RNA, 22 nt, Homo sapiens
ggcggcucgccaggcggcggcc

SEQ ID NO: 44050 - RNA, 18 nt, Homo sapiens
ggcugcugccgcccgggc

SEQ ID NO: 44051 - RNA, 21 nt, Homo sapiens
uccguggaaggaagguccugc

SEQ ID NO: 44052 - RNA, 18 nt, Homo sapiens
uggcacgagaaccacugc

SEQ ID NO: 44053 - RNA, 23 nt, Homo sapiens
cgcugaguuacauuugcuuaugc

SEQ ID NO: 44054 - RNA, 17 nt, Homo sapiens
cguuggggagagcagcg

SEQ ID NO: 44055 - RNA, 19 nt, Homo sapiens
cacuggacccauguggcag

SEQ ID NO: 44056 - RNA, 19 nt, Homo sapiens
gagccagauccucuggggu

SEQ ID NO: 44057 - RNA, 18 nt, Homo sapiens
gaggaaacaguugucaca

SEQ ID NO: 44058 - RNA, 19 nt, Homo sapiens
ggaggggcagagggacaag

SEQ ID NO: 44059 - RNA, 18 nt, Homo sapiens
uagaacugcuauucugac

SEQ ID NO: 44060 - RNA, 21 nt, Homo sapiens
aggggaaacaguccagagucc

SEQ ID NO: 44061 - RNA, 22 nt, Homo sapiens
aguggcggcaauggccucagcc

SEQ ID NO: 44062 - RNA, 20 nt, Homo sapiens
gcgccgcgcggcacggccug

SEQ ID NO: 44063 - RNA, 18 nt, Homo sapiens
gggaugcucagcuggggc

SEQ ID NO: 44064 - RNA, 19 nt, Homo sapiens
uggaagccaauggaaagcc

SEQ ID NO: 44065 - RNA, 16 nt, Homo sapiens
gaggaugaaccgcccu

SEQ ID NO: 44066 - RNA, 17 nt, Homo sapiens
agaggggaaagugaguc

SEQ ID NO: 44067 - RNA, 19 nt, Homo sapiens
cagucuccaguuuugggcc

SEQ ID NO: 44068 - RNA, 24 nt, Homo sapiens
cuaggggccuccagccccuggcac

SEQ ID NO: 44069 - RNA, 19 nt, Homo sapiens
ugagcugacucugucccuu

SEQ ID NO: 44070 - RNA, 16 nt, Homo sapiens
aagugcuacacugagu

SEQ ID NO: 44071 - RNA, 22 nt, Homo sapiens
agcugcaagucuuuugaaacaa

SEQ ID NO: 44072 - RNA, 18 nt, Homo sapiens
aggagggggagagggggc

SEQ ID NO: 44073 - RNA, 24 nt, Homo sapiens
auauuuacauauguauauauagau

SEQ ID NO: 44074 - RNA, 16 nt, Homo sapiens
caagucuuuugaaaca

SEQ ID NO: 44075 - RNA, 19 nt, Homo sapiens
gagagggggcgaagacggc

SEQ ID NO: 44076 - RNA, 17 nt, Homo sapiens
gcccgcgccggccgggc

SEQ ID NO: 44077 - RNA, 18 nt, Homo sapiens
gcggggagggggcgcgcg

SEQ ID NO: 44078 - RNA, 17 nt, Homo sapiens
gcggggcccgcgccggc

SEQ ID NO: 44079 - RNA, 17 nt, Homo sapiens
gcuggcucggagaagug

SEQ ID NO: 44080 - RNA, 18 nt, Homo sapiens
ggagagcgcgggaggagc

SEQ ID NO: 44081 - RNA, 16 nt, Homo sapiens
ggagggggagaggggg

SEQ ID NO: 44082 - RNA, 19 nt, Homo sapiens
ggcagagaagaagaaagga

SEQ ID NO: 44083 - RNA, 18 nt, Homo sapiens
ggggcugcagccucgcgc

SEQ ID NO: 44084 - RNA, 19 nt, Homo sapiens
uaaguggcauaaauuugga

SEQ ID NO: 44085 - RNA, 21 nt, Homo sapiens
ugcggcccucgggucgccggc

SEQ ID NO: 44086 - RNA, 19 nt, Homo sapiens
uggcacuuuuguacucuau

SEQ ID NO: 44087 - RNA, 18 nt, Homo sapiens
uguugggugguacucucu

SEQ ID NO: 44088 - RNA, 19 nt, Homo sapiens
agcugcccucccuguggcg

SEQ ID NO: 44089 - RNA, 22 nt, Homo sapiens
ccucguugguaggugaagaacc

SEQ ID NO: 44090 - RNA, 18 nt, Homo sapiens
cuacuugucaguagcugc

SEQ ID NO: 44091 - RNA, 21 nt, Homo sapiens
gcugcgcuuuccccucccuuc

SEQ ID NO: 44092 - RNA, 21 nt, Homo sapiens
auaacacagggcagaucucuc

SEQ ID NO: 44093 - RNA, 17 nt, Homo sapiens
ccuuccccucucucucc

SEQ ID NO: 44094 - RNA, 18 nt, Homo sapiens
cuggcccaguuacccugc

SEQ ID NO: 44095 - RNA, 20 nt, Homo sapiens
ggcagcuggcugcugguggc

SEQ ID NO: 44096 - RNA, 20 nt, Homo sapiens
gguggcuggcagcugguggc

SEQ ID NO: 44097 - RNA, 14 nt, Homo sapiens
guauuuacggaaaa

SEQ ID NO: 44098 - RNA, 19 nt, Homo sapiens
guggcuggcagcugguggc

SEQ ID NO: 44099 - RNA, 18 nt, Homo sapiens
uaauguuuguaaaagugc

SEQ ID NO: 44100 - RNA, 16 nt, Homo sapiens
uccccucucucucccu

SEQ ID NO: 44101 - RNA, 23 nt, Homo sapiens
ucuaucuuggcauugugugguuc

SEQ ID NO: 44102 - RNA, 19 nt, Homo sapiens
ugaauugauaccugaggug

SEQ ID NO: 44103 - RNA, 18 nt, Homo sapiens
uggcuggcagcugguggc

SEQ ID NO: 44104 - RNA, 22 nt, Homo sapiens
uguguauuuacggaaaauaagg

SEQ ID NO: 44105 - RNA, 17 nt, Homo sapiens
uucugcccuucccccag

SEQ ID NO: 44106 - RNA, 23 nt, Homo sapiens
uugaucucuguauagagauuuuu

SEQ ID NO: 44107 - RNA, 22 nt, Homo sapiens
agcgagugcuguuuggcacuuc

SEQ ID NO: 44108 - RNA, 15 nt, Homo sapiens
ccgggcucccaagaa

SEQ ID NO: 44109 - RNA, 19 nt, Homo sapiens
ggagaaaaugacuuagagc

SEQ ID NO: 44110 - RNA, 14 nt, Homo sapiens
ggggauguuggaug

SEQ ID NO: 44111 - RNA, 22 nt, Homo sapiens
ucaguacagucagcaaccuccu

SEQ ID NO: 44112 - RNA, 18 nt, Homo sapiens
uccucuuccccacccaga

SEQ ID NO: 44113 - RNA, 18 nt, Homo sapiens
ugcagcgagugcuguuug

SEQ ID NO: 44114 - RNA, 22 nt, Homo sapiens
acaaggcaccaaggcacaacug

SEQ ID NO: 44115 - RNA, 19 nt, Homo sapiens
gcuuccaaguucccaggcu

SEQ ID NO: 44116 - RNA, 18 nt, Homo sapiens
uggcugcagugacaucug

SEQ ID NO: 44117 - RNA, 21 nt, Homo sapiens
cccggcgcggccucccuggcg

SEQ ID NO: 44118 - RNA, 22 nt, Homo sapiens
ccugggcccucccugcgugccc

SEQ ID NO: 44119 - RNA, 17 nt, Homo sapiens
gugauucacccgucuug

SEQ ID NO: 44120 - RNA, 18 nt, Homo sapiens
caucaucagauuuuaugu

SEQ ID NO: 44121 - RNA, 17 nt, Homo sapiens
ccccugaauagauauag

SEQ ID NO: 44122 - RNA, 16 nt, Homo sapiens
gagccgagaucgugcc

SEQ ID NO: 44123 - RNA, 18 nt, Homo sapiens
gcagaaugaaaauucaag

SEQ ID NO: 44124 - RNA, 20 nt, Homo sapiens
ggaaauaaaaauagcaccag

SEQ ID NO: 44125 - RNA, 18 nt, Homo sapiens
uaaaauugcucugacugu

SEQ ID NO: 44126 - RNA, 21 nt, Homo sapiens
ugagucgagauugugccacug

SEQ ID NO: 44127 - RNA, 21 nt, Homo sapiens
uggcaugguggcaugcaccug

SEQ ID NO: 44128 - RNA, 23 nt, Homo sapiens
uucgggacuacccugaccgacau

SEQ ID NO: 44129 - RNA, 17 nt, Homo sapiens
uugggaggccaaggcgg

SEQ ID NO: 44130 - RNA, 19 nt, Homo sapiens
agcuguguccccuaccccc

SEQ ID NO: 44131 - RNA, 19 nt, Homo sapiens
aggagguggaggagggugg

SEQ ID NO: 44132 - RNA, 23 nt, Homo sapiens
agugaagcuagaagagaugugga

SEQ ID NO: 44133 - RNA, 21 nt, Homo sapiens
ccugggcccagccccacccag

SEQ ID NO: 44134 - RNA, 19 nt, Homo sapiens
gagaggagguggaggaggg

SEQ ID NO: 44135 - RNA, 16 nt, Homo sapiens
gagggcugggcugggc

SEQ ID NO: 44136 - RNA, 18 nt, Homo sapiens
gaggggguacacuguguc

SEQ ID NO: 44137 - RNA, 17 nt, Homo sapiens
gcaucugaaauccugcu

SEQ ID NO: 44138 - RNA, 19 nt, Homo sapiens
gccauccugcccacccacu

SEQ ID NO: 44139 - RNA, 16 nt, Homo sapiens
gcggcacagggauuga

SEQ ID NO: 44140 - RNA, 18 nt, Homo sapiens
ggagagaaauguucuggu

SEQ ID NO: 44141 - RNA, 24 nt, Homo sapiens
ggaggagggcgaagccaagggagg

SEQ ID NO: 44142 - RNA, 17 nt, Homo sapiens
ggcccggguggccgcuu

SEQ ID NO: 44143 - RNA, 23 nt, Homo sapiens
gggaacuugcaggagcuaaggcc

SEQ ID NO: 44144 - RNA, 17 nt, Homo sapiens
gggguguggcagcuggc

SEQ ID NO: 44145 - RNA, 23 nt, Homo sapiens
ggguggggagggauggggcuggg

SEQ ID NO: 44146 - RNA, 22 nt, Homo sapiens
uagaagagauguggacugugcc

SEQ ID NO: 44147 - RNA, 23 nt, Homo sapiens
uagcaggagcccgcuggcaguga

SEQ ID NO: 44148 - RNA, 22 nt, Homo sapiens
uccuuuacagcuugugacaccu

SEQ ID NO: 44149 - RNA, 21 nt, Homo sapiens
ucuaaauccccaguuucugca

SEQ ID NO: 44150 - RNA, 18 nt, Homo sapiens
ucucucggggaagggguc

SEQ ID NO: 44151 - RNA, 20 nt, Homo sapiens
ucucucggggaagggguccc

SEQ ID NO: 44152 - RNA, 16 nt, Homo sapiens
ucugacgccucuccug

SEQ ID NO: 44153 - RNA, 28 nt, Homo sapiens
ucuggugccucucccgcccuauccuggc

SEQ ID NO: 44154 - RNA, 18 nt, Homo sapiens
ugacgccucuccuggugu

SEQ ID NO: 44155 - RNA, 20 nt, Homo sapiens
ugagaggaugugggucucgg

SEQ ID NO: 44156 - RNA, 19 nt, Homo sapiens
ugccgaggaccugucccuc

SEQ ID NO: 44157 - RNA, 22 nt, Homo sapiens
ugugaugcgugugugacacugu

SEQ ID NO: 44158 - RNA, 19 nt, Homo sapiens
uucugcccggcuuccccag

SEQ ID NO: 44159 - RNA, 16 nt, Homo sapiens
agugaaggagcagaga

SEQ ID NO: 44160 - RNA, 20 nt, Homo sapiens
cagcaggugcagggugcggc

SEQ ID NO: 44161 - RNA, 22 nt, Homo sapiens
caggugcagggugcggcuaagu

SEQ ID NO: 44162 - RNA, 18 nt, Homo sapiens
cccuucucuaaggagcag

SEQ ID NO: 44163 - RNA, 16 nt, Homo sapiens
gagcagguggaagagu

SEQ ID NO: 44164 - RNA, 18 nt, Homo sapiens
ugaaggagcagagagggc

SEQ ID NO: 44165 - RNA, 22 nt, Homo sapiens
ugauggcugggauggccuucuu

SEQ ID NO: 44166 - RNA, 21 nt, Homo sapiens
acgccacgggaaaugccaagg

SEQ ID NO: 44167 - RNA, 15 nt, Homo sapiens
aacuuguugucagag

SEQ ID NO: 44168 - RNA, 22 nt, Homo sapiens
acaggccugggggaauggccuc

SEQ ID NO: 44169 - RNA, 16 nt, Homo sapiens
acguuuguagugaaug

SEQ ID NO: 44170 - RNA, 20 nt, Homo sapiens
agccugcgcauguguuugug

SEQ ID NO: 44171 - RNA, 19 nt, Homo sapiens
caugcaugugugcaggagc

SEQ ID NO: 44172 - RNA, 19 nt, Homo sapiens
cauguguacgugugggagc

SEQ ID NO: 44173 - RNA, 24 nt, Homo sapiens
ccgcggcccuucccagcuggcucg

SEQ ID NO: 44174 - RNA, 23 nt, Homo sapiens
cggcgggcggagcugcagugcgg

SEQ ID NO: 44175 - RNA, 22 nt, Homo sapiens
cgggggcagcgugggcagggcu

SEQ ID NO: 44176 - RNA, 23 nt, Homo sapiens
gcgcggggcgggcgugagggccg

SEQ ID NO: 44177 - RNA, 16 nt, Homo sapiens
ggguacggcggugcau

SEQ ID NO: 44178 - RNA, 16 nt, Homo sapiens
ggugcuuuccugaaag

SEQ ID NO: 44179 - RNA, 19 nt, Homo sapiens
gugcucugguagccugggc

SEQ ID NO: 44180 - RNA, 18 nt, Homo sapiens
gugugugcauguguguau

SEQ ID NO: 44181 - RNA, 19 nt, Homo sapiens
uaaggcugaaggauggcaa

SEQ ID NO: 44182 - RNA, 14 nt, Homo sapiens
uaccaagaaaagaa

SEQ ID NO: 44183 - RNA, 18 nt, Homo sapiens
ucacagagcagcuggugu

SEQ ID NO: 44184 - RNA, 16 nt, Homo sapiens
uccaugugcaucugug

SEQ ID NO: 44185 - RNA, 23 nt, Homo sapiens
ucuagaaauagaaaugccaguac

SEQ ID NO: 44186 - RNA, 16 nt, Homo sapiens
ucucccggcccucgca

SEQ ID NO: 44187 - RNA, 22 nt, Homo sapiens
ucucucugcugugcauacacgu

SEQ ID NO: 44188 - RNA, 20 nt, Homo sapiens
ugaaggauggcaauuaacaa

SEQ ID NO: 44189 - RNA, 19 nt, Homo sapiens
uggcacauguguguauaug

SEQ ID NO: 44190 - RNA, 22 nt, Homo sapiens
ugggugguggccgggcaagcag

SEQ ID NO: 44191 - RNA, 21 nt, Homo sapiens
ugguauguguacacgugcaug

SEQ ID NO: 44192 - RNA, 19 nt, Homo sapiens
uguacgugugcgugugugu

SEQ ID NO: 44193 - RNA, 14 nt, Homo sapiens
ugugugcaugcaug

SEQ ID NO: 44194 - RNA, 18 nt, Homo sapiens
ugugugcaugugugcagu

SEQ ID NO: 44195 - RNA, 25 nt, Homo sapiens
ugugugcauguguguaggagccugu

SEQ ID NO: 44196 - RNA, 22 nt, Homo sapiens
ugugugugugcaugugugcagu

SEQ ID NO: 44197 - RNA, 19 nt, Homo sapiens
uucaugauaugugcauaug

SEQ ID NO: 44198 - RNA, 18 nt, Homo sapiens
uugugugcaugcaugugu

SEQ ID NO: 44199 - RNA, 20 nt, Homo sapiens
uaucucagcuuggaaugugg

SEQ ID NO: 44200 - RNA, 25 nt, Homo sapiens
ucuggcaaugucucugguuuuugcu

SEQ ID NO: 44201 - RNA, 20 nt, Homo sapiens
uucagaacugcuuuuauuug

SEQ ID NO: 44202 - RNA, 18 nt, Homo sapiens
cucuagaacucauuuuaa

SEQ ID NO: 44203 - RNA, 16 nt, Homo sapiens
aucccaggaguuccag

SEQ ID NO: 44204 - RNA, 16 nt, Homo sapiens
ccaggcugcagugagc

SEQ ID NO: 44205 - RNA, 24 nt, Homo sapiens
gaccaccaucaccaucucugucgu

SEQ ID NO: 44206 - RNA, 20 nt, Homo sapiens
gcuuagcuggaaucuccauc

SEQ ID NO: 44207 - RNA, 21 nt, Homo sapiens
ggggugccccacccuuggcau

SEQ ID NO: 44208 - RNA, 17 nt, Homo sapiens
ucccugaccaccaucac

SEQ ID NO: 44209 - RNA, 16 nt, Homo sapiens
ucucugguuuucaacc

SEQ ID NO: 44210 - RNA, 18 nt, Homo sapiens
ucuuuuccgacugcaccu

SEQ ID NO: 44211 - RNA, 20 nt, Homo sapiens
aaauaguugacacucaauuu

SEQ ID NO: 44212 - RNA, 23 nt, Homo sapiens
ccuccucgcucuggcgucugucc

SEQ ID NO: 44213 - RNA, 20 nt, Homo sapiens
cgagcgcaccaggccgcugc

SEQ ID NO: 44214 - RNA, 19 nt, Homo sapiens
gcgucuguccggaggcucg

SEQ ID NO: 44215 - RNA, 23 nt, Homo sapiens
ggggaggggaugacagcaagggg

SEQ ID NO: 44216 - RNA, 23 nt, Homo sapiens
gggggaggggaugacagcaaggg

SEQ ID NO: 44217 - RNA, 21 nt, Homo sapiens
uguccggaggcucgcggcggc

SEQ ID NO: 44218 - RNA, 19 nt, Homo sapiens
accuucguuggccauugag

SEQ ID NO: 44219 - RNA, 17 nt, Homo sapiens
acuuuuucuagccggcg

SEQ ID NO: 44220 - RNA, 18 nt, Homo sapiens
agcgggagugggggcagc

SEQ ID NO: 44221 - RNA, 19 nt, Homo sapiens
agggcacuggagccauugc

SEQ ID NO: 44222 - RNA, 23 nt, Homo sapiens
caagucacugcagcuggccugcu

SEQ ID NO: 44223 - RNA, 14 nt, Homo sapiens
cacacuccugggga

SEQ ID NO: 44224 - RNA, 17 nt, Homo sapiens
ccaagggcucgaacccu

SEQ ID NO: 44225 - RNA, 31 nt, Homo sapiens
ccugcugugaaguuuugugugugugugugua

SEQ ID NO: 44226 - RNA, 21 nt, Homo sapiens
cgggagccgaagggccacucc

SEQ ID NO: 44227 - RNA, 21 nt, Homo sapiens
cuuccugugcaugggggcucc

SEQ ID NO: 44228 - RNA, 21 nt, Homo sapiens
ggaaacaagaggaacccugug

SEQ ID NO: 44229 - RNA, 18 nt, Homo sapiens
ggacgcuccucuguggcu

SEQ ID NO: 44230 - RNA, 19 nt, Homo sapiens
ggacgguggggaugaagcg

SEQ ID NO: 44231 - RNA, 17 nt, Homo sapiens
ggagccauugccugccu

SEQ ID NO: 44232 - RNA, 16 nt, Homo sapiens
ggcugcuuuugccugc

SEQ ID NO: 44233 - RNA, 15 nt, Homo sapiens
uaagugggugagugg

SEQ ID NO: 44234 - RNA, 22 nt, Homo sapiens
ugacaaggcgcugcauugggag

SEQ ID NO: 44235 - RNA, 16 nt, Homo sapiens
ugccacagucccugcc

SEQ ID NO: 44236 - RNA, 17 nt, Homo sapiens
ugggaaagacggggaca

SEQ ID NO: 44237 - RNA, 19 nt, Homo sapiens
ugggucgcagcaggugccc

SEQ ID NO: 44238 - RNA, 25 nt, Homo sapiens
ugugaaguuuugugugugugugugu

SEQ ID NO: 44239 - RNA, 19 nt, Homo sapiens
uguguguguguguguguaa

SEQ ID NO: 44240 - RNA, 18 nt, Homo sapiens
ugugugugugugugugug

SEQ ID NO: 44241 - RNA, 20 nt, Homo sapiens
ugugugugugugugugugua

SEQ ID NO: 44242 - RNA, 23 nt, Homo sapiens
uuugugugugugugugugugugu

SEQ ID NO: 44243 - RNA, 21 nt, Homo sapiens
ggcaagggcagagggcauggu

SEQ ID NO: 44244 - RNA, 20 nt, Homo sapiens
acccaggcaggcggcagagg

SEQ ID NO: 44245 - RNA, 21 nt, Homo sapiens
acugggcuggggcugggggug

SEQ ID NO: 44246 - RNA, 23 nt, Homo sapiens
agugagcuccucucgauagcccc

SEQ ID NO: 44247 - RNA, 21 nt, Homo sapiens
auuguuuggaagucacaguau

SEQ ID NO: 44248 - RNA, 23 nt, Homo sapiens
cagcgggcgcggggcucuggugc

SEQ ID NO: 44249 - RNA, 19 nt, Homo sapiens
cgucuucuccucgcgccgc

SEQ ID NO: 44250 - RNA, 18 nt, Homo sapiens
cuugugggcuggccacag

SEQ ID NO: 44251 - RNA, 18 nt, Homo sapiens
gauggggguggggaaggg

SEQ ID NO: 44252 - RNA, 18 nt, Homo sapiens
ggacaccguggggcaggc

SEQ ID NO: 44253 - RNA, 18 nt, Homo sapiens
ggacugggcuggggcugg

SEQ ID NO: 44254 - RNA, 20 nt, Homo sapiens
ggggaugggauggggguggg

SEQ ID NO: 44255 - RNA, 24 nt, Homo sapiens
gggguggggaugggaugggggugg

SEQ ID NO: 44256 - RNA, 22 nt, Homo sapiens
gggguguggcagagggauacgg

SEQ ID NO: 44257 - RNA, 17 nt, Homo sapiens
ucugucugcagcacggc

SEQ ID NO: 44258 - RNA, 18 nt, Homo sapiens
ugagcuccucucgauagc

SEQ ID NO: 44259 - RNA, 20 nt, Homo sapiens
ugaggcugccauccacgccg

SEQ ID NO: 44260 - RNA, 21 nt, Homo sapiens
ugggauggggguggggaaggg

SEQ ID NO: 44261 - RNA, 30 nt, Homo sapiens
uggggcuggggguggggaugggaugggggc

SEQ ID NO: 44262 - RNA, 19 nt, Homo sapiens
uguuuggaagucacaguau

SEQ ID NO: 44263 - RNA, 20 nt, Homo sapiens
agggaaguaggauggacagg

SEQ ID NO: 44264 - RNA, 18 nt, Homo sapiens
uacccagguucccucccc

SEQ ID NO: 44265 - RNA, 14 nt, Homo sapiens
ucaaagaucacagc

SEQ ID NO: 44266 - RNA, 16 nt, Homo sapiens
uccuguccaguuugca

SEQ ID NO: 44267 - RNA, 22 nt, Homo sapiens
ugcugagcagucccggcuccca

SEQ ID NO: 44268 - RNA, 20 nt, Homo sapiens
uguccaggggacuggaggug

SEQ ID NO: 44269 - RNA, 18 nt, Homo sapiens
cccugcccccgccggccc

SEQ ID NO: 44270 - RNA, 22 nt, Homo sapiens
ccgccgagcgugccgaggcggg

SEQ ID NO: 44271 - RNA, 18 nt, Homo sapiens
ccgcgccccacgcugccc

SEQ ID NO: 44272 - RNA, 17 nt, Homo sapiens
ccugccguccggcuucc

SEQ ID NO: 44273 - RNA, 16 nt, Homo sapiens
gagagguucccggggu

SEQ ID NO: 44274 - RNA, 20 nt, Homo sapiens
gggguggggugggagcaggg

SEQ ID NO: 44275 - RNA, 22 nt, Homo sapiens
ucggccacugcgggagggcagg

SEQ ID NO: 44276 - RNA, 22 nt, Homo sapiens
augaccacauggcauaacguua

SEQ ID NO: 44277 - RNA, 20 nt, Homo sapiens
cucuaauucucuucucaaau

SEQ ID NO: 44278 - RNA, 18 nt, Homo sapiens
gccaggugguuuuguuug

SEQ ID NO: 44279 - RNA, 18 nt, Homo sapiens
ggggguagguaucuucuu

SEQ ID NO: 44280 - RNA, 20 nt, Homo sapiens
uagguaucuucuuagaaagu

SEQ ID NO: 44281 - RNA, 21 nt, Homo sapiens
uaguaggcugcuugugauugg

SEQ ID NO: 44282 - RNA, 17 nt, Homo sapiens
uugggaggccgaggcgg

SEQ ID NO: 44283 - RNA, 16 nt, Homo sapiens
aaaugcugugaugugg

SEQ ID NO: 44284 - RNA, 16 nt, Homo sapiens
aaaugcuuucugaaaa

SEQ ID NO: 44285 - RNA, 17 nt, Homo sapiens
gaacugucuagaaaaca

SEQ ID NO: 44286 - RNA, 20 nt, Homo sapiens
uagaaauaacauuuuaccca

SEQ ID NO: 44287 - RNA, 16 nt, Homo sapiens
ucuguaguaauuccag

SEQ ID NO: 44288 - RNA, 25 nt, Homo sapiens
ucuuuauucuuuuauuauucauuuu

SEQ ID NO: 44289 - RNA, 15 nt, Homo sapiens
ccugucuccagguuc

SEQ ID NO: 44290 - RNA, 21 nt, Homo sapiens
uccgacaucuucccuggaugc

SEQ ID NO: 44291 - RNA, 22 nt, Homo sapiens
uccugagacuauaggaaucuca

SEQ ID NO: 44292 - RNA, 19 nt, Homo sapiens
ugguuuggugacuguggag

SEQ ID NO: 44293 - RNA, 18 nt, Homo sapiens
agaccccggcagcccucc

SEQ ID NO: 44294 - RNA, 19 nt, Homo sapiens
cacaccuuugcacuucuga

SEQ ID NO: 44295 - RNA, 19 nt, Homo sapiens
caggacugaagucuuagga

SEQ ID NO: 44296 - RNA, 18 nt, Homo sapiens
cccaagcccagaccccgg

SEQ ID NO: 44297 - RNA, 21 nt, Homo sapiens
cccuuuccgcugggugccagc

SEQ ID NO: 44298 - RNA, 23 nt, Homo sapiens
gaauaccucuugaauaaauuccu

SEQ ID NO: 44299 - RNA, 17 nt, Homo sapiens
gaggugucccacauagu

SEQ ID NO: 44300 - RNA, 19 nt, Homo sapiens
gcgccgccgcucacuucag

SEQ ID NO: 44301 - RNA, 22 nt, Homo sapiens
uucguuuauuaauuacaccaag

SEQ ID NO: 44302 - RNA, 17 nt, Homo sapiens
uuuacaauagaaacugu

SEQ ID NO: 44303 - RNA, 24 nt, Homo sapiens
caguguccuuuccagaaacuauuu

SEQ ID NO: 44304 - RNA, 15 nt, Homo sapiens
cgggcagcuccaccg

SEQ ID NO: 44305 - RNA, 20 nt, Homo sapiens
ggaggcgaguguggggccgg

SEQ ID NO: 44306 - RNA, 18 nt, Homo sapiens
cccaaacugaucuuuaca

SEQ ID NO: 44307 - RNA, 18 nt, Homo sapiens
cccuggcccauacuuugc

SEQ ID NO: 44308 - RNA, 19 nt, Homo sapiens
cuuugucuggugucaguac

SEQ ID NO: 44309 - RNA, 21 nt, Homo sapiens
uaauaugcuaauaguaucuaa

SEQ ID NO: 44310 - RNA, 18 nt, Homo sapiens
ugaaagcuugcagacugc

SEQ ID NO: 44311 - RNA, 18 nt, Homo sapiens
uguauugugguaguuugc

SEQ ID NO: 44312 - RNA, 18 nt, Homo sapiens
uuacaggaaaaacaccaa

SEQ ID NO: 44313 - RNA, 20 nt, Homo sapiens
uuauaugcacguuuuauaag

SEQ ID NO: 44314 - RNA, 18 nt, Homo sapiens
uuguauauaugauauacc

SEQ ID NO: 44315 - RNA, 20 nt, Homo sapiens
accaguaucacauuuaggag

SEQ ID NO: 44316 - RNA, 17 nt, Homo sapiens
cgccgccccgccccgcc

SEQ ID NO: 44317 - RNA, 15 nt, Homo sapiens
gauguguguaagaga

SEQ ID NO: 44318 - RNA, 20 nt, Homo sapiens
uaaggauuaaugcaaaucug

SEQ ID NO: 44319 - RNA, 20 nt, Homo sapiens
uggaaaacauuugagaaguu

SEQ ID NO: 44320 - RNA, 23 nt, Homo sapiens
uggcgccaauagaggaaagaaaa

SEQ ID NO: 44321 - RNA, 18 nt, Homo sapiens
uuuguguggggggagggg

SEQ ID NO: 44322 - RNA, 18 nt, Homo sapiens
acacaccauauuugguaa

SEQ ID NO: 44323 - RNA, 22 nt, Homo sapiens
acucaaguugcuuuaaaaauuu

SEQ ID NO: 44324 - RNA, 19 nt, Homo sapiens
cucacucauugacagaaaa

SEQ ID NO: 44325 - RNA, 17 nt, Homo sapiens
cuguguauguuucacag

SEQ ID NO: 44326 - RNA, 14 nt, Homo sapiens
gaugaugaucacgg

SEQ ID NO: 44327 - RNA, 15 nt, Homo sapiens
gggcgaagcuggagc

SEQ ID NO: 44328 - RNA, 24 nt, Homo sapiens
uaaaaauuugauuugcaggaaaac

SEQ ID NO: 44329 - RNA, 17 nt, Homo sapiens
uacaagaaauuacaaga

SEQ ID NO: 44330 - RNA, 20 nt, Homo sapiens
uugugaacaccacuacuaua

SEQ ID NO: 44331 - RNA, 18 nt, Homo sapiens
ccacuugcgcaucuacag

SEQ ID NO: 44332 - RNA, 14 nt, Homo sapiens
cugcaccacucucu

SEQ ID NO: 44333 - RNA, 18 nt, Homo sapiens
cuucucgcccgcuccucc

SEQ ID NO: 44334 - RNA, 20 nt, Homo sapiens
ggcuuccuucucccagggcc

SEQ ID NO: 44335 - RNA, 21 nt, Homo sapiens
uagaaaagaaggcaacaugaa

SEQ ID NO: 44336 - RNA, 15 nt, Homo sapiens
uccacaucagggcug

SEQ ID NO: 44337 - RNA, 16 nt, Homo sapiens
uggccgagugccuugc

SEQ ID NO: 44338 - RNA, 20 nt, Homo sapiens
cuucuuugccuucaguccgc

SEQ ID NO: 44339 - RNA, 18 nt, Homo sapiens
gaaggugcuggguggggu

SEQ ID NO: 44340 - RNA, 25 nt, Homo sapiens
uuccugcgugucugggaaggugcug

SEQ ID NO: 44341 - RNA, 19 nt, Homo sapiens
aggccagaccugcagcacc

SEQ ID NO: 44342 - RNA, 20 nt, Homo sapiens
cucuuuacuaugaauuuucu

SEQ ID NO: 44343 - RNA, 20 nt, Homo sapiens
cuuauguauaguaaguguug

SEQ ID NO: 44344 - RNA, 19 nt, Homo sapiens
uaauaagaguugaggacca

SEQ ID NO: 44345 - RNA, 16 nt, Homo sapiens
uguaggguuuuucucc

SEQ ID NO: 44346 - RNA, 21 nt, Homo sapiens
uuugccacauucuucacauuu

SEQ ID NO: 44347 - RNA, 20 nt, Homo sapiens
acucuggcuuccccuccccc

SEQ ID NO: 44348 - RNA, 17 nt, Homo sapiens
ccccuccccccuccccc

SEQ ID NO: 44349 - RNA, 19 nt, Homo sapiens
gcuggcucagggccaaaug

SEQ ID NO: 44350 - RNA, 18 nt, Homo sapiens
ugaugccacuagccuaaa

SEQ ID NO: 44351 - RNA, 17 nt, Homo sapiens
uugccaggagcuuucag

SEQ ID NO: 44352 - RNA, 19 nt, Homo sapiens
acagccacucuuuggcucg

SEQ ID NO: 44353 - RNA, 22 nt, Homo sapiens
ccguucugcagggcugcucuga

SEQ ID NO: 44354 - RNA, 18 nt, Homo sapiens
agcuggcacaggagcagg

SEQ ID NO: 44355 - RNA, 18 nt, Homo sapiens
ccugugaccuuuguggac

SEQ ID NO: 44356 - RNA, 18 nt, Homo sapiens
cuccgucucgggggcggg

SEQ ID NO: 44357 - RNA, 16 nt, Homo sapiens
ggguacaaaauggcgu

SEQ ID NO: 44358 - RNA, 21 nt, Homo sapiens
ggugaaagggggaagagauug

SEQ ID NO: 44359 - RNA, 19 nt, Homo sapiens
uaccagcuggcacaggagc

SEQ ID NO: 44360 - RNA, 17 nt, Homo sapiens
uccuggaggagcugggg

SEQ ID NO: 44361 - RNA, 18 nt, Homo sapiens
ugauuaaacaauauacca

SEQ ID NO: 44362 - RNA, 20 nt, Homo sapiens
uggcacaggagcagggggca

SEQ ID NO: 44363 - RNA, 17 nt, Homo sapiens
uugggaggccgaggugg

SEQ ID NO: 44364 - RNA, 24 nt, Homo sapiens
ccugaaagacuaguaaaagaggcu

SEQ ID NO: 44365 - RNA, 20 nt, Homo sapiens
cgcuguggggcuucgagugg

SEQ ID NO: 44366 - RNA, 23 nt, Homo sapiens
gcgcgugguaucggccugagcca

SEQ ID NO: 44367 - RNA, 22 nt, Homo sapiens
uauauguauacauauauuuaua

SEQ ID NO: 44368 - RNA, 18 nt, Homo sapiens
ucucugaaucuuugccgc

SEQ ID NO: 44369 - RNA, 17 nt, Homo sapiens
aggcagauaggcgggcg

SEQ ID NO: 44370 - RNA, 18 nt, Homo sapiens
caccaggccggcaggcag

SEQ ID NO: 44371 - RNA, 17 nt, Homo sapiens
ggcgaaagagaaggcag

SEQ ID NO: 44372 - RNA, 19 nt, Homo sapiens
acacuuuaaacguacaaua

SEQ ID NO: 44373 - RNA, 18 nt, Homo sapiens
ccgccgccagcccacgcc

SEQ ID NO: 44374 - RNA, 19 nt, Homo sapiens
ccuccuccuccuccugguc

SEQ ID NO: 44375 - RNA, 22 nt, Homo sapiens
cgcuccggcggcggcgggggcc

SEQ ID NO: 44376 - RNA, 26 nt, Homo sapiens
gaguaucgucacuauggucgucgucg

SEQ ID NO: 44377 - RNA, 17 nt, Homo sapiens
gcgguuagggucgggcc

SEQ ID NO: 44378 - RNA, 22 nt, Homo sapiens
gggccccggcugcggcggccgc

SEQ ID NO: 44379 - RNA, 20 nt, Homo sapiens
guggcgguuagggucgggcc

SEQ ID NO: 44380 - RNA, 17 nt, Homo sapiens
guggcugacaaaaccuc

SEQ ID NO: 44381 - RNA, 23 nt, Homo sapiens
uaguguuuuauuaacuaccacac

SEQ ID NO: 44382 - RNA, 18 nt, Homo sapiens
uauuuguugauucugcaa

SEQ ID NO: 44383 - RNA, 16 nt, Homo sapiens
ucagagagggagacag

SEQ ID NO: 44384 - RNA, 17 nt, Homo sapiens
uccuacccccaaugggc

SEQ ID NO: 44385 - RNA, 17 nt, Homo sapiens
uggaaucuggacuagau

SEQ ID NO: 44386 - RNA, 19 nt, Homo sapiens
uuguuauguuugcauaugu

SEQ ID NO: 44387 - RNA, 21 nt, Homo sapiens
uuuuauuaacuaccacacugu

SEQ ID NO: 44388 - RNA, 20 nt, Homo sapiens
gcugcucuccccgccuucug

SEQ ID NO: 44389 - RNA, 21 nt, Homo sapiens
gggagggaugagaggagcggg

SEQ ID NO: 44390 - RNA, 19 nt, Homo sapiens
uauuguguacuuagcuaua

SEQ ID NO: 44391 - RNA, 18 nt, Homo sapiens
uccccucucuccacuuug

SEQ ID NO: 44392 - RNA, 22 nt, Homo sapiens
ugcucugcuuccccacccccau

SEQ ID NO: 44393 - RNA, 19 nt, Homo sapiens
ugggagggaugagaggagc

SEQ ID NO: 44394 - RNA, 15 nt, Homo sapiens
aaaacagaucacuuu

SEQ ID NO: 44395 - RNA, 18 nt, Homo sapiens
acaaugaccaccauggca

SEQ ID NO: 44396 - RNA, 19 nt, Homo sapiens
cacuagccagcacugucac

SEQ ID NO: 44397 - RNA, 21 nt, Homo sapiens
cuggaggcugucaaaacuccu

SEQ ID NO: 44398 - RNA, 16 nt, Homo sapiens
cuuuggaggggagggg

SEQ ID NO: 44399 - RNA, 18 nt, Homo sapiens
cuuuguauugacaggauc

SEQ ID NO: 44400 - RNA, 17 nt, Homo sapiens
gcauuuccagcaguguc

SEQ ID NO: 44401 - RNA, 21 nt, Homo sapiens
gcuuggccaggucaggacugu

SEQ ID NO: 44402 - RNA, 18 nt, Homo sapiens
ggacucuucgauaguaac

SEQ ID NO: 44403 - RNA, 18 nt, Homo sapiens
ggggcccuuugucuugaa

SEQ ID NO: 44404 - RNA, 23 nt, Homo sapiens
gggggcauuaucauugguauccu

SEQ ID NO: 44405 - RNA, 16 nt, Homo sapiens
gucccuggcaguuacu

SEQ ID NO: 44406 - RNA, 16 nt, Homo sapiens
guccuccaucaguggc

SEQ ID NO: 44407 - RNA, 18 nt, Homo sapiens
gugaaaauuuccccagug

SEQ ID NO: 44408 - RNA, 20 nt, Homo sapiens
uacuggauuucuguggagug

SEQ ID NO: 44409 - RNA, 23 nt, Homo sapiens
ucaguggcuuugacaucaaaagu

SEQ ID NO: 44410 - RNA, 15 nt, Homo sapiens
ucccacaucaguagg

SEQ ID NO: 44411 - RNA, 21 nt, Homo sapiens
ugacaggagauggaaacaugg

SEQ ID NO: 44412 - RNA, 20 nt, Homo sapiens
uguagacaaggcuggcgcug

SEQ ID NO: 44413 - RNA, 18 nt, Homo sapiens
ugugaauggcugucuccu

SEQ ID NO: 44414 - RNA, 19 nt, Homo sapiens
uuaaagcugaauucuuugg

SEQ ID NO: 44415 - RNA, 21 nt, Homo sapiens
uuugauaggguuggcuacuau

SEQ ID NO: 44416 - RNA, 22 nt, Homo sapiens
uuuguauugacaggaucuuucu

SEQ ID NO: 44417 - RNA, 18 nt, Homo sapiens
acagcacuuggcacauca

SEQ ID NO: 44418 - RNA, 18 nt, Homo sapiens
acugguggguuugggcac

SEQ ID NO: 44419 - RNA, 17 nt, Homo sapiens
ccugaaaacacaaagcc

SEQ ID NO: 44420 - RNA, 19 nt, Homo sapiens
gcaggaggagccagcagga

SEQ ID NO: 44421 - RNA, 15 nt, Homo sapiens
gcauucccuucugca

SEQ ID NO: 44422 - RNA, 20 nt, Homo sapiens
gcugcacuauuucaagagcc

SEQ ID NO: 44423 - RNA, 21 nt, Homo sapiens
gggagaggguccaguggcuuc

SEQ ID NO: 44424 - RNA, 21 nt, Homo sapiens
ggugugcguuuuucuuccagc

SEQ ID NO: 44425 - RNA, 19 nt, Homo sapiens
ucuucuaccagcacgaugg

SEQ ID NO: 44426 - RNA, 19 nt, Homo sapiens
ugggcaggaggagccagca

SEQ ID NO: 44427 - RNA, 24 nt, Homo sapiens
uuauuaucuauaucuccacccuca

SEQ ID NO: 44428 - RNA, 19 nt, Homo sapiens
agggcggcgaggcgcgcgg

SEQ ID NO: 44429 - RNA, 20 nt, Homo sapiens
caaggagaggcccuggaggc

SEQ ID NO: 44430 - RNA, 18 nt, Homo sapiens
caggaccuuuuuagcccc

SEQ ID NO: 44431 - RNA, 18 nt, Homo sapiens
gggcggcgaggcgcgcgg

SEQ ID NO: 44432 - RNA, 18 nt, Homo sapiens
cagcacucaucacccucc

SEQ ID NO: 44433 - RNA, 17 nt, Homo sapiens
cccggggccgagauccc

SEQ ID NO: 44434 - RNA, 18 nt, Homo sapiens
cgccggcgcgcggccggg

SEQ ID NO: 44435 - RNA, 18 nt, Homo sapiens
cggcccgccucccggggc

SEQ ID NO: 44436 - RNA, 15 nt, Homo sapiens
gcgccggcgcgcggc

SEQ ID NO: 44437 - RNA, 21 nt, Homo sapiens
gcgccggcgcgcggccgggcg

SEQ ID NO: 44438 - RNA, 19 nt, Homo sapiens
uaagcugcagaaauggaaa

SEQ ID NO: 44439 - RNA, 20 nt, Homo sapiens
ucgccaccaggcccugcugc

SEQ ID NO: 44440 - RNA, 16 nt, Homo sapiens
ugccaggggaaacgug

SEQ ID NO: 44441 - RNA, 15 nt, Homo sapiens
uggcaggagagcggc

SEQ ID NO: 44442 - RNA, 21 nt, Homo sapiens
acagaaauugaccuuuauuug

SEQ ID NO: 44443 - RNA, 18 nt, Homo sapiens
agcugugggccaucagcu

SEQ ID NO: 44444 - RNA, 22 nt, Homo sapiens
agguccuaccccaacgacacuu

SEQ ID NO: 44445 - RNA, 18 nt, Homo sapiens
caccaacaagaaccuccc

SEQ ID NO: 44446 - RNA, 18 nt, Homo sapiens
cagcggcagcauacacuc

SEQ ID NO: 44447 - RNA, 17 nt, Homo sapiens
cagcucgcggcugacau

SEQ ID NO: 44448 - RNA, 18 nt, Homo sapiens
cauccaggcugcgcaggg

SEQ ID NO: 44449 - RNA, 19 nt, Homo sapiens
cauguccucccaugacugc

SEQ ID NO: 44450 - RNA, 22 nt, Homo sapiens
cauuuuaguacagaaaauccca

SEQ ID NO: 44451 - RNA, 16 nt, Homo sapiens
ccaaagcaaagcagcc

SEQ ID NO: 44452 - RNA, 17 nt, Homo sapiens
ccacucugccuguaacu

SEQ ID NO: 44453 - RNA, 16 nt, Homo sapiens
cccgcagcagcugccc

SEQ ID NO: 44454 - RNA, 18 nt, Homo sapiens
ccgcacggucccgcuccc

SEQ ID NO: 44455 - RNA, 21 nt, Homo sapiens
ccugguuccggauccuucccc

SEQ ID NO: 44456 - RNA, 16 nt, Homo sapiens
gaaaacugggagcaga

SEQ ID NO: 44457 - RNA, 18 nt, Homo sapiens
gaaaggagcugcugccuc

SEQ ID NO: 44458 - RNA, 22 nt, Homo sapiens
gaggugagguccucaucacagg

SEQ ID NO: 44459 - RNA, 24 nt, Homo sapiens
gcuguaucaaguuccguuuguuau

SEQ ID NO: 44460 - RNA, 23 nt, Homo sapiens
gcuucagcaaccgcugguucucc

SEQ ID NO: 44461 - RNA, 21 nt, Homo sapiens
ggaggugagguccucaucaca

SEQ ID NO: 44462 - RNA, 21 nt, Homo sapiens
uacaguuuuucauaguuuguc

SEQ ID NO: 44463 - RNA, 22 nt, Homo sapiens
uaccuguaaaacaaaggacagc

SEQ ID NO: 44464 - RNA, 23 nt, Homo sapiens
ucaacaccugcugcugcugggca

SEQ ID NO: 44465 - RNA, 21 nt, Homo sapiens
ucacucaugaugagcuuguac

SEQ ID NO: 44466 - RNA, 17 nt, Homo sapiens
uccuggagcuccgggga

SEQ ID NO: 44467 - RNA, 18 nt, Homo sapiens
ucucccacagcaagggac

SEQ ID NO: 44468 - RNA, 18 nt, Homo sapiens
ucugggagguuuuggggg

SEQ ID NO: 44469 - RNA, 15 nt, Homo sapiens
ucuucaccugcgugg

SEQ ID NO: 44470 - RNA, 23 nt, Homo sapiens
ugauagugacaauaaccauuaug

SEQ ID NO: 44471 - RNA, 27 nt, Homo sapiens
ugcugcugggcacggaggugccugggg

SEQ ID NO: 44472 - RNA, 17 nt, Homo sapiens
uggccgugucauacagu

SEQ ID NO: 44473 - RNA, 16 nt, Homo sapiens
ugggggugucagaggc

SEQ ID NO: 44474 - RNA, 19 nt, Homo sapiens
uucaaggcguuggugugcu

SEQ ID NO: 44475 - RNA, 20 nt, Homo sapiens
caucaaguucucucucuucu

SEQ ID NO: 44476 - RNA, 19 nt, Homo sapiens
cccagggcugcuggcugac

SEQ ID NO: 44477 - RNA, 16 nt, Homo sapiens
cccggcagccuagccc

SEQ ID NO: 44478 - RNA, 18 nt, Homo sapiens
gaagagaggggaagagaa

SEQ ID NO: 44479 - RNA, 22 nt, Homo sapiens
gaagagaggggaagagaagaau

SEQ ID NO: 44480 - RNA, 22 nt, Homo sapiens
gccagcgaacacggucagcagc

SEQ ID NO: 44481 - RNA, 19 nt, Homo sapiens
ucagggcaucgacugaggc

SEQ ID NO: 44482 - RNA, 18 nt, Homo sapiens
acaugcucacacacauuc

SEQ ID NO: 44483 - RNA, 20 nt, Homo sapiens
aggcggcggcggcggcgcgg

SEQ ID NO: 44484 - RNA, 22 nt, Homo sapiens
cacacauucacccccgguacac

SEQ ID NO: 44485 - RNA, 18 nt, Homo sapiens
cccccggccgccgcugcc

SEQ ID NO: 44486 - RNA, 18 nt, Homo sapiens
ccugaacuggcccccugg

SEQ ID NO: 44487 - RNA, 23 nt, Homo sapiens
gacaggcggcggcggcggcgcgg

SEQ ID NO: 44488 - RNA, 19 nt, Homo sapiens
gcccaccccaccaucugac

SEQ ID NO: 44489 - RNA, 21 nt, Homo sapiens
ggcggcggcgcgggcccaugg

SEQ ID NO: 44490 - RNA, 17 nt, Homo sapiens
ggugacaggcggcggcg

SEQ ID NO: 44491 - RNA, 20 nt, Homo sapiens
ucccccacucaccucuccca

SEQ ID NO: 44492 - RNA, 17 nt, Homo sapiens
ugcagauuggagggugg

SEQ ID NO: 44493 - RNA, 24 nt, Homo sapiens
ugcccugggccuugugggaccccc

SEQ ID NO: 44494 - RNA, 26 nt, Homo sapiens
agaggaaaugggcccagggacaugcc

SEQ ID NO: 44495 - RNA, 20 nt, Homo sapiens
agcucaagccuggcagcucc

SEQ ID NO: 44496 - RNA, 21 nt, Homo sapiens
cagccuggucaacagagugag

SEQ ID NO: 44497 - RNA, 18 nt, Homo sapiens
cccucuccuccugcuccc

SEQ ID NO: 44498 - RNA, 15 nt, Homo sapiens
cucuccguggggccc

SEQ ID NO: 44499 - RNA, 19 nt, Homo sapiens
cuuuuauaaucuucacaca

SEQ ID NO: 44500 - RNA, 19 nt, Homo sapiens
gccaaaaugccaaaauacc

SEQ ID NO: 44501 - RNA, 21 nt, Homo sapiens
ucaccucccaaaggccccacc

SEQ ID NO: 44502 - RNA, 16 nt, Homo sapiens
ucugagccaaaaugcc

SEQ ID NO: 44503 - RNA, 23 nt, Homo sapiens
ugacuuacgugcaaaccuaagac

SEQ ID NO: 44504 - RNA, 20 nt, Homo sapiens
ugcuccccuucuggggcucc

SEQ ID NO: 44505 - RNA, 19 nt, Homo sapiens
uggagaaaauaaccacauc

SEQ ID NO: 44506 - RNA, 15 nt, Homo sapiens
uguccaggggcggug

SEQ ID NO: 44507 - RNA, 19 nt, Homo sapiens
uguggggagaaacagggcc

SEQ ID NO: 44508 - RNA, 16 nt, Homo sapiens
aagaguucaaagauuu

SEQ ID NO: 44509 - RNA, 21 nt, Homo sapiens
aagaucuugggacuuuucuac

SEQ ID NO: 44510 - RNA, 21 nt, Homo sapiens
aaucccgaaacaucugcauug

SEQ ID NO: 44511 - RNA, 14 nt, Homo sapiens
agaacuguugcacg

SEQ ID NO: 44512 - RNA, 22 nt, Homo sapiens
agcaagcacugugguuuaacaa

SEQ ID NO: 44513 - RNA, 20 nt, Homo sapiens
agcagcaccacaacaaugau

SEQ ID NO: 44514 - RNA, 22 nt, Homo sapiens
agccuugaacaagauauuuagc

SEQ ID NO: 44515 - RNA, 18 nt, Homo sapiens
agcuaaagcugaagugcu

SEQ ID NO: 44516 - RNA, 16 nt, Homo sapiens
aggaaagaaagaaaca

SEQ ID NO: 44517 - RNA, 23 nt, Homo sapiens
augaugauguuaaauugggucca

SEQ ID NO: 44518 - RNA, 20 nt, Homo sapiens
cacauuuauugcaguucggg

SEQ ID NO: 44519 - RNA, 16 nt, Homo sapiens
caggaauggagaugaa

SEQ ID NO: 44520 - RNA, 16 nt, Homo sapiens
cgucgucagggucagc

SEQ ID NO: 44521 - RNA, 27 nt, Homo sapiens
cuaaugucuaauuagauuaauguuuuu

SEQ ID NO: 44522 - RNA, 20 nt, Homo sapiens
cucccuuagaagcuuauccu

SEQ ID NO: 44523 - RNA, 19 nt, Homo sapiens
cucgaacuccugaccuugu

SEQ ID NO: 44524 - RNA, 19 nt, Homo sapiens
cugcuguugcugcugcugg

SEQ ID NO: 44525 - RNA, 21 nt, Homo sapiens
cuuggagagaugaguucaccu

SEQ ID NO: 44526 - RNA, 18 nt, Homo sapiens
gaaaagauagucugcagg

SEQ ID NO: 44527 - RNA, 23 nt, Homo sapiens
gaaguauuguugcuuuaguuuuc

SEQ ID NO: 44528 - RNA, 24 nt, Homo sapiens
gaguauugcuuuaauggucaauuu

SEQ ID NO: 44529 - RNA, 17 nt, Homo sapiens
ggaagagaggacacaca

SEQ ID NO: 44530 - RNA, 15 nt, Homo sapiens
ggacuuuucuacccc

SEQ ID NO: 44531 - RNA, 18 nt, Homo sapiens
ggggggggcagggggcgg

SEQ ID NO: 44532 - RNA, 21 nt, Homo sapiens
uaaaaaguguaggaccaaggu

SEQ ID NO: 44533 - RNA, 23 nt, Homo sapiens
uacagggguggucggcgccgggc

SEQ ID NO: 44534 - RNA, 21 nt, Homo sapiens
uaugauggcuuuucucuugga

SEQ ID NO: 44535 - RNA, 24 nt, Homo sapiens
ucaauuuuucaauaccuuuuaagg

SEQ ID NO: 44536 - RNA, 20 nt, Homo sapiens
ucccagaacuguugcacggu

SEQ ID NO: 44537 - RNA, 21 nt, Homo sapiens
ucgaacuccugaccuugugau

SEQ ID NO: 44538 - RNA, 18 nt, Homo sapiens
ucucaccaccuuuaaucc

SEQ ID NO: 44539 - RNA, 17 nt, Homo sapiens
ucuuuggaguuuuaacu

SEQ ID NO: 44540 - RNA, 17 nt, Homo sapiens
ugaagccccugauaacc

SEQ ID NO: 44541 - RNA, 19 nt, Homo sapiens
ugacaggcuauguucacau

SEQ ID NO: 44542 - RNA, 23 nt, Homo sapiens
uggaggucaaagugguuuugggc

SEQ ID NO: 44543 - RNA, 17 nt, Homo sapiens
uggggaggacgcugcug

SEQ ID NO: 44544 - RNA, 19 nt, Homo sapiens
uguuucagaaacauucccu

SEQ ID NO: 44545 - RNA, 23 nt, Homo sapiens
uuauuuaaaaauaaacagauuuc

SEQ ID NO: 44546 - RNA, 14 nt, Homo sapiens
uucaacucaucacu

SEQ ID NO: 44547 - RNA, 16 nt, Homo sapiens
uuccaaucaaagcugu

SEQ ID NO: 44548 - RNA, 21 nt, Homo sapiens
auacuguagaauauggccaua

SEQ ID NO: 44549 - RNA, 19 nt, Homo sapiens
cacuuuggucaccaggguc

SEQ ID NO: 44550 - RNA, 21 nt, Homo sapiens
caggaaacuggauugucgugg

SEQ ID NO: 44551 - RNA, 19 nt, Homo sapiens
uauuccacacacguggaau

SEQ ID NO: 44552 - RNA, 17 nt, Homo sapiens
ugggggcuuucacggcg

SEQ ID NO: 44553 - RNA, 19 nt, Homo sapiens
uuccgauuccaccucuucc

SEQ ID NO: 44554 - RNA, 17 nt, Homo sapiens
aggggguggggcgccgg

SEQ ID NO: 44555 - RNA, 21 nt, Homo sapiens
cgggcccggcggugagggcgg

SEQ ID NO: 44556 - RNA, 19 nt, Homo sapiens
cucuagcuaagguuauaga

SEQ ID NO: 44557 - RNA, 16 nt, Homo sapiens
gcgcauguacaagacc

SEQ ID NO: 44558 - RNA, 18 nt, Homo sapiens
ggccuggaggggcgauga

SEQ ID NO: 44559 - RNA, 16 nt, Homo sapiens
gguggggcgccggggg

SEQ ID NO: 44560 - RNA, 15 nt, Homo sapiens
uggggcgccgggggc

SEQ ID NO: 44561 - RNA, 17 nt, Homo sapiens
aggcggcggggccggcg

SEQ ID NO: 44562 - RNA, 16 nt, Homo sapiens
cagggcgagaggcggc

SEQ ID NO: 44563 - RNA, 17 nt, Homo sapiens
cagugcguguugaccgc

SEQ ID NO: 44564 - RNA, 21 nt, Homo sapiens
cagugcguguugaccgcggcc

SEQ ID NO: 44565 - RNA, 21 nt, Homo sapiens
cgggcgcgggggcagcucgcg

SEQ ID NO: 44566 - RNA, 14 nt, Homo sapiens
gcagcggcggcagc

SEQ ID NO: 44567 - RNA, 16 nt, Homo sapiens
gcgcgggggcagcucg

SEQ ID NO: 44568 - RNA, 20 nt, Homo sapiens
ggggcucgggucccgggcug

SEQ ID NO: 44569 - RNA, 21 nt, Homo sapiens
ugaccgcggccucugggcccg

SEQ ID NO: 44570 - RNA, 15 nt, Homo sapiens
uggaagggcagcggc

SEQ ID NO: 44571 - RNA, 19 nt, Homo sapiens
uggcgccgcggagcccggc

SEQ ID NO: 44572 - RNA, 16 nt, Homo sapiens
ugggcccgagggcggc

SEQ ID NO: 44573 - RNA, 16 nt, Homo sapiens
gaaggcauaggcagug

SEQ ID NO: 44574 - RNA, 19 nt, Homo sapiens
agcgcuucgugaagaagga

SEQ ID NO: 44575 - RNA, 21 nt, Homo sapiens
agugugcgugcguguuagaga

SEQ ID NO: 44576 - RNA, 21 nt, Homo sapiens
caggguagggagguguggagg

SEQ ID NO: 44577 - RNA, 15 nt, Homo sapiens
cccagcccggccuga

SEQ ID NO: 44578 - RNA, 17 nt, Homo sapiens
ccugugcauggccgugg

SEQ ID NO: 44579 - RNA, 18 nt, Homo sapiens
cucaccccggggcucgag

SEQ ID NO: 44580 - RNA, 15 nt, Homo sapiens
gagagagagagagag

SEQ ID NO: 44581 - RNA, 19 nt, Homo sapiens
gagagagagagagagaaag

SEQ ID NO: 44582 - RNA, 17 nt, Homo sapiens
gcgugugccugugugag

SEQ ID NO: 44583 - RNA, 17 nt, Homo sapiens
ggaaggagcaggagcgg

SEQ ID NO: 44584 - RNA, 17 nt, Homo sapiens
ggaggggaggggaucag

SEQ ID NO: 44585 - RNA, 16 nt, Homo sapiens
gggaaggagcaggagc

SEQ ID NO: 44586 - RNA, 17 nt, Homo sapiens
gggggcgcgcagggcgc

SEQ ID NO: 44587 - RNA, 16 nt, Homo sapiens
uagcugcgacggucug

SEQ ID NO: 44588 - RNA, 21 nt, Homo sapiens
ugcgccaccccucuucucccc

SEQ ID NO: 44589 - RNA, 18 nt, Homo sapiens
ugcgugagcgccugcccc

SEQ ID NO: 44590 - RNA, 21 nt, Homo sapiens
uggccgugggcuuggcucagc

SEQ ID NO: 44591 - RNA, 22 nt, Homo sapiens
uggggaggggaggggaucagga

SEQ ID NO: 44592 - RNA, 20 nt, Homo sapiens
ugguagaagcaaggcauaca

SEQ ID NO: 44593 - RNA, 20 nt, Homo sapiens
ugugggccagccccagaugu

SEQ ID NO: 44594 - RNA, 19 nt, Homo sapiens
agcuguucaacagacauug

SEQ ID NO: 44595 - RNA, 17 nt, Homo sapiens
cacgugguucaacguga

SEQ ID NO: 44596 - RNA, 20 nt, Homo sapiens
caguggcucacaccugucau

SEQ ID NO: 44597 - RNA, 14 nt, Homo sapiens
ccaggauuacugcu

SEQ ID NO: 44598 - RNA, 23 nt, Homo sapiens
cgggcagaucaccugaggucagg

SEQ ID NO: 44599 - RNA, 16 nt, Homo sapiens
gaaccugagaggcgga

SEQ ID NO: 44600 - RNA, 17 nt, Homo sapiens
gagguugcagugagcca

SEQ ID NO: 44601 - RNA, 19 nt, Homo sapiens
ggcccuggugguaggugcc

SEQ ID NO: 44602 - RNA, 26 nt, Homo sapiens
guucagauccgcguguuuccuuccag

SEQ ID NO: 44603 - RNA, 23 nt, Homo sapiens
ugccuguaaucccagcacuuugg

SEQ ID NO: 44604 - RNA, 22 nt, Homo sapiens
uggccuagaaaacagcaguuuc

SEQ ID NO: 44605 - RNA, 23 nt, Homo sapiens
ugggcauuuagaagagucaagag

SEQ ID NO: 44606 - RNA, 17 nt, Homo sapiens
uugggaggcugaggugg

SEQ ID NO: 44607 - RNA, 19 nt, Homo sapiens
gcacauucuuuuuuggggg

SEQ ID NO: 44608 - RNA, 20 nt, Homo sapiens
ucuugcaguacaaauccagg

SEQ ID NO: 44609 - RNA, 22 nt, Homo sapiens
uguacaaaaauaccugcuguug

SEQ ID NO: 44610 - RNA, 15 nt, Homo sapiens
aagcuuuucggagcu

SEQ ID NO: 44611 - RNA, 20 nt, Homo sapiens
ccgcggagcugcgagccugu

SEQ ID NO: 44612 - RNA, 20 nt, Homo sapiens
cgccucggucugagccgugc

SEQ ID NO: 44613 - RNA, 18 nt, Homo sapiens
ggauguauguucauucuu

SEQ ID NO: 44614 - RNA, 19 nt, Homo sapiens
ugcugcgcggcggcgccag

SEQ ID NO: 44615 - RNA, 16 nt, Homo sapiens
gccgcccgggccgccc

SEQ ID NO: 44616 - RNA, 20 nt, Homo sapiens
guggaucacaaggucaggag

SEQ ID NO: 44617 - RNA, 20 nt, Homo sapiens
uaccuaguggccgcccgggc

SEQ ID NO: 44618 - RNA, 17 nt, Homo sapiens
uugggaggccaaggcgg

SEQ ID NO: 44619 - RNA, 19 nt, Homo sapiens
cugggagggugucacccga

SEQ ID NO: 44620 - RNA, 19 nt, Homo sapiens
gagggugucacccgagguu

SEQ ID NO: 44621 - RNA, 18 nt, Homo sapiens
gcuccuucuucugaguug

SEQ ID NO: 44622 - RNA, 18 nt, Homo sapiens
cggaaauaaaguaucaca

SEQ ID NO: 44623 - RNA, 15 nt, Homo sapiens
gcaaaauagaaaaca

SEQ ID NO: 44624 - RNA, 19 nt, Homo sapiens
uaaaagguaaauuucuguu

SEQ ID NO: 44625 - RNA, 19 nt, Homo sapiens
uacuacaaaugagugacag

SEQ ID NO: 44626 - RNA, 21 nt, Homo sapiens
uccagaacuaggaagaaaaua

SEQ ID NO: 44627 - RNA, 16 nt, Homo sapiens
ugucagugccaugccc

SEQ ID NO: 44628 - RNA, 18 nt, Homo sapiens
ugugugugugugugugug

SEQ ID NO: 44629 - RNA, 20 nt, Homo sapiens
ugugugugugugugugugua

SEQ ID NO: 44630 - RNA, 21 nt, Homo sapiens
uguguuugugugugugugugu

SEQ ID NO: 44631 - RNA, 22 nt, Homo sapiens
uuaauugccauuguaacagugu

SEQ ID NO: 44632 - RNA, 22 nt, Homo sapiens
uugcuuuuauuaaaaauguaaa

SEQ ID NO: 44633 - RNA, 23 nt, Homo sapiens
uuugugugugugugugugugugu

SEQ ID NO: 44634 - RNA, 18 nt, Homo sapiens
uuuguguucuuuccacau

SEQ ID NO: 44635 - RNA, 19 nt, Homo sapiens
aaagguuagagacaagaug

SEQ ID NO: 44636 - RNA, 14 nt, Homo sapiens
aggcaggaacugaa

SEQ ID NO: 44637 - RNA, 17 nt, Homo sapiens
aggggaggggaggaugg

SEQ ID NO: 44638 - RNA, 21 nt, Homo sapiens
aggggaggggaggauggggga

SEQ ID NO: 44639 - RNA, 18 nt, Homo sapiens
cacacacgcucacccccc

SEQ ID NO: 44640 - RNA, 19 nt, Homo sapiens
cagcacaaacuagaaaaua

SEQ ID NO: 44641 - RNA, 14 nt, Homo sapiens
gcacaaaucuaucu

SEQ ID NO: 44642 - RNA, 24 nt, Homo sapiens
gcaggccuuucccugaggcuucuc

SEQ ID NO: 44643 - RNA, 21 nt, Homo sapiens
gggaaagcacaagaaaaagaa

SEQ ID NO: 44644 - RNA, 21 nt, Homo sapiens
guuguucuccaagcaucuugu

SEQ ID NO: 44645 - RNA, 18 nt, Homo sapiens
uaaaaugcaagcacaucu

SEQ ID NO: 44646 - RNA, 20 nt, Homo sapiens
uauccaaguggcgucucggc

SEQ ID NO: 44647 - RNA, 18 nt, Homo sapiens
ucucggcugcuucuaacc

SEQ ID NO: 44648 - RNA, 16 nt, Homo sapiens
ucugaguaaaaugggg

SEQ ID NO: 44649 - RNA, 20 nt, Homo sapiens
ugaaaaaggauacaugagga

SEQ ID NO: 44650 - RNA, 17 nt, Homo sapiens
ugacagauaugccacug

SEQ ID NO: 44651 - RNA, 21 nt, Homo sapiens
ugaggggaggggaggaugggg

SEQ ID NO: 44652 - RNA, 20 nt, Homo sapiens
ugcuguaacugaucaagcau

SEQ ID NO: 44653 - RNA, 17 nt, Homo sapiens
uuauuucuggacauucc

SEQ ID NO: 44654 - RNA, 18 nt, Homo sapiens
uugcuaguuuaggaacag

SEQ ID NO: 44655 - RNA, 19 nt, Homo sapiens
uuggggguuggggagaggg

SEQ ID NO: 44656 - RNA, 18 nt, Homo sapiens
uuugaugcugcaaaugcc

SEQ ID NO: 44657 - RNA, 21 nt, Homo sapiens
aaaaaagaaccaagaaaaggc

SEQ ID NO: 44658 - RNA, 15 nt, Homo sapiens
aagagcugaaagcug

SEQ ID NO: 44659 - RNA, 19 nt, Homo sapiens
agcugucugggaacugagc

SEQ ID NO: 44660 - RNA, 16 nt, Homo sapiens
aggcaugacauauacu

SEQ ID NO: 44661 - RNA, 19 nt, Homo sapiens
cacacauuugcuucaagga

SEQ ID NO: 44662 - RNA, 21 nt, Homo sapiens
caugaaaaaacaaaccuaaga

SEQ ID NO: 44663 - RNA, 17 nt, Homo sapiens
ccucccggggaccgcgg

SEQ ID NO: 44664 - RNA, 20 nt, Homo sapiens
cuaaaauaauaucuaacucu

SEQ ID NO: 44665 - RNA, 19 nt, Homo sapiens
gaguguuuauauauucagu

SEQ ID NO: 44666 - RNA, 29 nt, Homo sapiens
gccccuucccgcccgcacaccuugccccg

SEQ ID NO: 44667 - RNA, 18 nt, Homo sapiens
uaaucaauacauuuggga

SEQ ID NO: 44668 - RNA, 16 nt, Homo sapiens
ugaccacagaacaaca

SEQ ID NO: 44669 - RNA, 22 nt, Homo sapiens
ccgccgcucggaucucccuccg

SEQ ID NO: 44670 - RNA, 18 nt, Homo sapiens
gcccuggaagccuggcag

SEQ ID NO: 44671 - RNA, 18 nt, Homo sapiens
gcggggcaggggaccugc

SEQ ID NO: 44672 - RNA, 16 nt, Homo sapiens
cuuucccguuggggcu

SEQ ID NO: 44673 - RNA, 19 nt, Homo sapiens
auugagugccugcugguuc

SEQ ID NO: 44674 - RNA, 22 nt, Homo sapiens
gcaguuuucaucuauaauagcc

SEQ ID NO: 44675 - RNA, 20 nt, Homo sapiens
aaaggaaaggaaaaaggaaa

SEQ ID NO: 44676 - RNA, 18 nt, Homo sapiens
aagugcaaaaaacaaaaa

SEQ ID NO: 44677 - RNA, 18 nt, Homo sapiens
augcgguuuguuuuuguu

SEQ ID NO: 44678 - RNA, 19 nt, Homo sapiens
caucaucaucauuuuuuaa

SEQ ID NO: 44679 - RNA, 19 nt, Homo sapiens
cccccgucguccugcuccc

SEQ ID NO: 44680 - RNA, 17 nt, Homo sapiens
ccgaggagcgggcgccc

SEQ ID NO: 44681 - RNA, 16 nt, Homo sapiens
ccgccgcccgcugccc

SEQ ID NO: 44682 - RNA, 16 nt, Homo sapiens
ccucccucuuucuccu

SEQ ID NO: 44683 - RNA, 17 nt, Homo sapiens
cgcugccuccgccgccc

SEQ ID NO: 44684 - RNA, 20 nt, Homo sapiens
cucccugucucuuuugcucc

SEQ ID NO: 44685 - RNA, 17 nt, Homo sapiens
cuccuucucucuguguc

SEQ ID NO: 44686 - RNA, 18 nt, Homo sapiens
cugaagagaggggggaaa

SEQ ID NO: 44687 - RNA, 20 nt, Homo sapiens
cugaagagaggggggaaaau

SEQ ID NO: 44688 - RNA, 17 nt, Homo sapiens
gauguuaggaaagggaa

SEQ ID NO: 44689 - RNA, 15 nt, Homo sapiens
gccuccgccgcccgc

SEQ ID NO: 44690 - RNA, 19 nt, Homo sapiens
gcgccgaggagcgggcgcc

SEQ ID NO: 44691 - RNA, 19 nt, Homo sapiens
gggagggagagggagaggc

SEQ ID NO: 44692 - RNA, 15 nt, Homo sapiens
ggggguggggggaag

SEQ ID NO: 44693 - RNA, 19 nt, Homo sapiens
ggggugggggugggggugg

SEQ ID NO: 44694 - RNA, 19 nt, Homo sapiens
ggguggggggaaggaaagg

SEQ ID NO: 44695 - RNA, 19 nt, Homo sapiens
ggguggggguggggggaag

SEQ ID NO: 44696 - RNA, 17 nt, Homo sapiens
gucucuuuugcuccaug

SEQ ID NO: 44697 - RNA, 17 nt, Homo sapiens
ucaaggauuugaaacag

SEQ ID NO: 44698 - RNA, 19 nt, Homo sapiens
ugaaaacuugccgccgugc

SEQ ID NO: 44699 - RNA, 19 nt, Homo sapiens
ugauaaacggaauaccugc

SEQ ID NO: 44700 - RNA, 16 nt, Homo sapiens
ugauugacagcucccc

SEQ ID NO: 44701 - RNA, 14 nt, Homo sapiens
uggcgcggccucgg

SEQ ID NO: 44702 - RNA, 22 nt, Homo sapiens
ugggauggggcuagauauggaa

SEQ ID NO: 44703 - RNA, 17 nt, Homo sapiens
ugggggugggggugggg

SEQ ID NO: 44704 - RNA, 18 nt, Homo sapiens
uggggugggggugggggu

SEQ ID NO: 44705 - RNA, 23 nt, Homo sapiens
ugggguggggguggggguggggg

SEQ ID NO: 44706 - RNA, 18 nt, Homo sapiens
uguccguuucuguggggu

SEQ ID NO: 44707 - RNA, 22 nt, Homo sapiens
uguuuggggugggggugggggu

SEQ ID NO: 44708 - RNA, 15 nt, Homo sapiens
uugcaggcguggauu

SEQ ID NO: 44709 - RNA, 22 nt, Homo sapiens
uugggguggggguggggguggg

SEQ ID NO: 44710 - RNA, 21 nt, Homo sapiens
acccgggaugaacaccacacc

SEQ ID NO: 44711 - RNA, 15 nt, Homo sapiens
gcuccgaaagaacca

SEQ ID NO: 44712 - RNA, 18 nt, Homo sapiens
uaagguuugguggagcug

SEQ ID NO: 44713 - RNA, 18 nt, Homo sapiens
uaccagauaagucaauga

SEQ ID NO: 44714 - RNA, 20 nt, Homo sapiens
ucagggcagcgcgagcggcc

SEQ ID NO: 44715 - RNA, 23 nt, Homo sapiens
uggagcugcaugaucaacaggau

SEQ ID NO: 44716 - RNA, 23 nt, Homo sapiens
cggcgcgccgcaggaaggugcag

SEQ ID NO: 44717 - RNA, 19 nt, Homo sapiens
aaagugaagcaucucaagg

SEQ ID NO: 44718 - RNA, 20 nt, Homo sapiens
acauugaggcugggcaggcc

SEQ ID NO: 44719 - RNA, 19 nt, Homo sapiens
ccacggcccacacgugccc

SEQ ID NO: 44720 - RNA, 19 nt, Homo sapiens
ccagcugcgcguugaccgc

SEQ ID NO: 44721 - RNA, 23 nt, Homo sapiens
cccccgccccgcccccgccuccc

SEQ ID NO: 44722 - RNA, 21 nt, Homo sapiens
ccucccgggcggaucagguuc

SEQ ID NO: 44723 - RNA, 18 nt, Homo sapiens
ccucggggaggccgcggc

SEQ ID NO: 44724 - RNA, 18 nt, Homo sapiens
ccuguccccgcaucuggc

SEQ ID NO: 44725 - RNA, 19 nt, Homo sapiens
cggggagccaggccugggg

SEQ ID NO: 44726 - RNA, 19 nt, Homo sapiens
cucccgggcggaucagguu

SEQ ID NO: 44727 - RNA, 15 nt, Homo sapiens
cucugaggggagggg

SEQ ID NO: 44728 - RNA, 22 nt, Homo sapiens
gagcagucugcggauggcugag

SEQ ID NO: 44729 - RNA, 21 nt, Homo sapiens
gaggccccuucccuuguuucc

SEQ ID NO: 44730 - RNA, 16 nt, Homo sapiens
gcccccuggcucagcu

SEQ ID NO: 44731 - RNA, 20 nt, Homo sapiens
gcgcccccgccccgcccccg

SEQ ID NO: 44732 - RNA, 22 nt, Homo sapiens
gcuccgcccgccugucaaggcc

SEQ ID NO: 44733 - RNA, 18 nt, Homo sapiens
gcucuucagcuguggacu

SEQ ID NO: 44734 - RNA, 19 nt, Homo sapiens
gcuggggcgccgcgcccgc

SEQ ID NO: 44735 - RNA, 19 nt, Homo sapiens
ggaggggagcgugcagccc

SEQ ID NO: 44736 - RNA, 20 nt, Homo sapiens
ggcagcugccagggggcuug

SEQ ID NO: 44737 - RNA, 16 nt, Homo sapiens
ggcuggugggcagcgg

SEQ ID NO: 44738 - RNA, 19 nt, Homo sapiens
gggcugcauucuccccugg

SEQ ID NO: 44739 - RNA, 21 nt, Homo sapiens
ggguggugggagggccugggg

SEQ ID NO: 44740 - RNA, 15 nt, Homo sapiens
gguggugggagggcc

SEQ ID NO: 44741 - RNA, 17 nt, Homo sapiens
uaacaggaagcaggaag

SEQ ID NO: 44742 - RNA, 21 nt, Homo sapiens
ugagcccucggggagccaggc

SEQ ID NO: 44743 - RNA, 22 nt, Homo sapiens
acgaggcggccagcgcguggcg

SEQ ID NO: 44744 - RNA, 19 nt, Homo sapiens
acgguaguugagcguggcu

SEQ ID NO: 44745 - RNA, 19 nt, Homo sapiens
agacgguaguugagcgugg

SEQ ID NO: 44746 - RNA, 20 nt, Homo sapiens
cagcggggggacgaggcggc

SEQ ID NO: 44747 - RNA, 18 nt, Homo sapiens
cagggccccgggggccaa

SEQ ID NO: 44748 - RNA, 18 nt, Homo sapiens
ccacggccacggugacgc

SEQ ID NO: 44749 - RNA, 19 nt, Homo sapiens
cccuugggccgggcucggg

SEQ ID NO: 44750 - RNA, 17 nt, Homo sapiens
ccguguucaccaccggg

SEQ ID NO: 44751 - RNA, 19 nt, Homo sapiens
ccucggcaggguccgcccc

SEQ ID NO: 44752 - RNA, 14 nt, Homo sapiens
cgggcgcccagggg

SEQ ID NO: 44753 - RNA, 20 nt, Homo sapiens
gaaccaaagauggugauacg

SEQ ID NO: 44754 - RNA, 17 nt, Homo sapiens
gccacgaggcgggcgcc

SEQ ID NO: 44755 - RNA, 18 nt, Homo sapiens
gccgcccggggcgccgcc

SEQ ID NO: 44756 - RNA, 23 nt, Homo sapiens
gccggggccgcccggggcgccgc

SEQ ID NO: 44757 - RNA, 19 nt, Homo sapiens
gcuggaagcggcgggcgcc

SEQ ID NO: 44758 - RNA, 18 nt, Homo sapiens
ggcaggcggcgggggccg

SEQ ID NO: 44759 - RNA, 20 nt, Homo sapiens
gggggccggcgugugcccgg

SEQ ID NO: 44760 - RNA, 19 nt, Homo sapiens
gguacaggcaguccucgcu

SEQ ID NO: 44761 - RNA, 19 nt, Homo sapiens
gugcagguggggcacgagc

SEQ ID NO: 44762 - RNA, 23 nt, Homo sapiens
ucguccggugcccggcgcagggc

SEQ ID NO: 44763 - RNA, 16 nt, Homo sapiens
ugaggaagaggaggga

SEQ ID NO: 44764 - RNA, 23 nt, Homo sapiens
uggcgggcagcgccccgugcagg

SEQ ID NO: 44765 - RNA, 21 nt, Homo sapiens
aaacaucucuguggucccagu

SEQ ID NO: 44766 - RNA, 19 nt, Homo sapiens
aggcagcccugggucgggg

SEQ ID NO: 44767 - RNA, 18 nt, Homo sapiens
ccgcagcccaccaggggc

SEQ ID NO: 44768 - RNA, 16 nt, Homo sapiens
cggcaacagcaaagca

SEQ ID NO: 44769 - RNA, 15 nt, Homo sapiens
gaggggcacugcggc

SEQ ID NO: 44770 - RNA, 22 nt, Homo sapiens
gcagcccugggucggggugguu

SEQ ID NO: 44771 - RNA, 17 nt, Homo sapiens
gcccugggucggggugg

SEQ ID NO: 44772 - RNA, 16 nt, Homo sapiens
gcggcagagagggcgc

SEQ ID NO: 44773 - RNA, 18 nt, Homo sapiens
gcggcagagagggcggcg

SEQ ID NO: 44774 - RNA, 19 nt, Homo sapiens
ggccguggcaccugaggga

SEQ ID NO: 44775 - RNA, 21 nt, Homo sapiens
gggcugggagagggggggcug

SEQ ID NO: 44776 - RNA, 18 nt, Homo sapiens
ugagcccuugcaauggcc

SEQ ID NO: 44777 - RNA, 18 nt, Homo sapiens
ugcugggguggaagccug

SEQ ID NO: 44778 - RNA, 21 nt, Homo sapiens
gcaucuguuccaggucucugu

SEQ ID NO: 44779 - RNA, 19 nt, Homo sapiens
uaggguugcuguacaaaau

SEQ ID NO: 44780 - RNA, 22 nt, Homo sapiens
ugaaaacccuauguccaaauac

SEQ ID NO: 44781 - RNA, 18 nt, Homo sapiens
aauuuguaagccacacgg

SEQ ID NO: 44782 - RNA, 16 nt, Homo sapiens
accugaaagcaccauc

SEQ ID NO: 44783 - RNA, 18 nt, Homo sapiens
cgcaggaaggggggcucc

SEQ ID NO: 44784 - RNA, 17 nt, Homo sapiens
cggauggagggauccuc

SEQ ID NO: 44785 - RNA, 16 nt, Homo sapiens
cggcgcggccacucug

SEQ ID NO: 44786 - RNA, 17 nt, Homo sapiens
cuggagugcaggaacug

SEQ ID NO: 44787 - RNA, 14 nt, Homo sapiens
gaucaugggaaagg

SEQ ID NO: 44788 - RNA, 20 nt, Homo sapiens
gcccguuccggggauccucc

SEQ ID NO: 44789 - RNA, 15 nt, Homo sapiens
ggaaugcaccaggua

SEQ ID NO: 44790 - RNA, 19 nt, Homo sapiens
ggaaugcaccagguagggu

SEQ ID NO: 44791 - RNA, 18 nt, Homo sapiens
ggccacacccagugcaga

SEQ ID NO: 44792 - RNA, 15 nt, Homo sapiens
ggccugagcguggcc

SEQ ID NO: 44793 - RNA, 21 nt, Homo sapiens
gguggcccgcaugccgggccu

SEQ ID NO: 44794 - RNA, 23 nt, Homo sapiens
ccuuaaacuacaaugaaccacag

SEQ ID NO: 44795 - RNA, 18 nt, Homo sapiens
cuauuacaaguaguauca

SEQ ID NO: 44796 - RNA, 19 nt, Homo sapiens
ucaacagauguagcuggca

SEQ ID NO: 44797 - RNA, 16 nt, Homo sapiens
cagagacagacaucuu

SEQ ID NO: 44798 - RNA, 14 nt, Homo sapiens
cgacgcgcgcggag

SEQ ID NO: 44799 - RNA, 18 nt, Homo sapiens
guaagugaccccuugaug

SEQ ID NO: 44800 - RNA, 18 nt, Homo sapiens
uaaguccauguggcacac

SEQ ID NO: 44801 - RNA, 21 nt, Homo sapiens
ucuuaaguuagaguacacauc

SEQ ID NO: 44802 - RNA, 17 nt, Homo sapiens
ugagaaacaaggugacc

SEQ ID NO: 44803 - RNA, 17 nt, Homo sapiens
ugcccuuucaacugcag

SEQ ID NO: 44804 - RNA, 19 nt, Homo sapiens
aaguagaaaaacuaauguu

SEQ ID NO: 44805 - RNA, 18 nt, Homo sapiens
auguacagaagccuaaau

SEQ ID NO: 44806 - RNA, 21 nt, Homo sapiens
cagguucugaaaacggcauuu

SEQ ID NO: 44807 - RNA, 22 nt, Homo sapiens
gagaccauuuccauuauuuaug

SEQ ID NO: 44808 - RNA, 23 nt, Homo sapiens
gcucggcggcagcaaauggcgcc

SEQ ID NO: 44809 - RNA, 15 nt, Homo sapiens
gggaauaagagagga

SEQ ID NO: 44810 - RNA, 19 nt, Homo sapiens
uaguaagaguagauuagag

SEQ ID NO: 44811 - RNA, 19 nt, Homo sapiens
uauaaacaucuaaauuauc

SEQ ID NO: 44812 - RNA, 17 nt, Homo sapiens
agcugggagggccaugu

SEQ ID NO: 44813 - RNA, 19 nt, Homo sapiens
cagguccuggugguacaag

SEQ ID NO: 44814 - RNA, 19 nt, Homo sapiens
cuauuuuccuaagaggauu

SEQ ID NO: 44815 - RNA, 21 nt, Homo sapiens
uaacauuuaugacuccaaaca

SEQ ID NO: 44816 - RNA, 22 nt, Homo sapiens
uauguuauccacuuaaaaugua

SEQ ID NO: 44817 - RNA, 20 nt, Homo sapiens
ucuacauuucuugugguaca

SEQ ID NO: 44818 - RNA, 20 nt, Homo sapiens
ugaagcugucagguccuggu

SEQ ID NO: 44819 - RNA, 17 nt, Homo sapiens
ugcugaaaaauaaaaua

SEQ ID NO: 44820 - RNA, 20 nt, Homo sapiens
ugguaauauaaacaugcauu

SEQ ID NO: 44821 - RNA, 19 nt, Homo sapiens
uggugaaauuuaagaauuu

SEQ ID NO: 44822 - RNA, 18 nt, Homo sapiens
uuagugcagguacuacca

SEQ ID NO: 44823 - RNA, 19 nt, Homo sapiens
agauggguguucacagggg

SEQ ID NO: 44824 - RNA, 18 nt, Homo sapiens
cauggccgccuuggggag

SEQ ID NO: 44825 - RNA, 18 nt, Homo sapiens
cccuggaugagggggugg

SEQ ID NO: 44826 - RNA, 21 nt, Homo sapiens
ccuacagcuugguaaguccua

SEQ ID NO: 44827 - RNA, 19 nt, Homo sapiens
cgcggccuccugccugccu

SEQ ID NO: 44828 - RNA, 17 nt, Homo sapiens
cgugggaaggggaagcc

SEQ ID NO: 44829 - RNA, 18 nt, Homo sapiens
cuccauggaaggcaguuu

SEQ ID NO: 44830 - RNA, 22 nt, Homo sapiens
cucgggggggcgcugcccuccg

SEQ ID NO: 44831 - RNA, 15 nt, Homo sapiens
gcaguuuugugaaua

SEQ ID NO: 44832 - RNA, 17 nt, Homo sapiens
gccgggcgccgggcgcc

SEQ ID NO: 44833 - RNA, 19 nt, Homo sapiens
gcggcggguggcagcgcgg

SEQ ID NO: 44834 - RNA, 23 nt, Homo sapiens
gcgggcgucagggcggcaggggc

SEQ ID NO: 44835 - RNA, 15 nt, Homo sapiens
ggcggcacuuccaug

SEQ ID NO: 44836 - RNA, 23 nt, Homo sapiens
ggguggcagcgcgggagaccggg

SEQ ID NO: 44837 - RNA, 21 nt, Homo sapiens
ugggcuggaccccacccccgc

SEQ ID NO: 44838 - RNA, 19 nt, Homo sapiens
uguucacaggggcagaggc

SEQ ID NO: 44839 - RNA, 20 nt, Homo sapiens
uucguccugaucucgggggg

SEQ ID NO: 44840 - RNA, 17 nt, Homo sapiens
uuucaggaucaucugua

SEQ ID NO: 44841 - RNA, 23 nt, Homo sapiens
acggagguccgcgcggcgaagcc

SEQ ID NO: 44842 - RNA, 18 nt, Homo sapiens
auguagaaaguaauagcu

SEQ ID NO: 44843 - RNA, 18 nt, Homo sapiens
uagauaccagcuguguug

SEQ ID NO: 44844 - RNA, 18 nt, Homo sapiens
uccagcugcacuccaagg

SEQ ID NO: 44845 - RNA, 19 nt, Homo sapiens
ucuuuggcuuuaaucugau

SEQ ID NO: 44846 - RNA, 19 nt, Homo sapiens
ugauugcugggccaaugga

SEQ ID NO: 44847 - RNA, 26 nt, Homo sapiens
caaguuuaagacagguuuauuuuauu

SEQ ID NO: 44848 - RNA, 20 nt, Homo sapiens
ccggcuccggcucaguggcc

SEQ ID NO: 44849 - RNA, 15 nt, Homo sapiens
ccugcagccagcacu

SEQ ID NO: 44850 - RNA, 19 nt, Homo sapiens
cgggcucgggcccgggucc

SEQ ID NO: 44851 - RNA, 20 nt, Homo sapiens
cuacugcucgggcucgggcc

SEQ ID NO: 44852 - RNA, 18 nt, Homo sapiens
gcucaggccggcuccggc

SEQ ID NO: 44853 - RNA, 17 nt, Homo sapiens
uaagaacgugaccugga

SEQ ID NO: 44854 - RNA, 24 nt, Homo sapiens
uaagcucaguaagacuaacugggc

SEQ ID NO: 44855 - RNA, 20 nt, Homo sapiens
ugaauaaacaggccaggaua

SEQ ID NO: 44856 - RNA, 15 nt, Homo sapiens
ugccccaaaaagcag

SEQ ID NO: 44857 - RNA, 14 nt, Homo sapiens
uuggauaacgcaac

SEQ ID NO: 44858 - RNA, 25 nt, Homo sapiens
uuuacaaagauucaaaacauuacca

SEQ ID NO: 44859 - RNA, 22 nt, Homo sapiens
aagagggucaugguggacaugg

SEQ ID NO: 44860 - RNA, 18 nt, Homo sapiens
uggaacaggaaagaugau

SEQ ID NO: 44861 - RNA, 19 nt, Homo sapiens
uuuaagagggaaguaagaa

SEQ ID NO: 44862 - RNA, 21 nt, Homo sapiens
cccuggugugugugugugugu

SEQ ID NO: 44863 - RNA, 23 nt, Homo sapiens
gcgccccuuuucuagagccuucc

SEQ ID NO: 44864 - RNA, 19 nt, Homo sapiens
ggagaacgggcgcggagag

SEQ ID NO: 44865 - RNA, 16 nt, Homo sapiens
ggaggaggccgcggcc

SEQ ID NO: 44866 - RNA, 17 nt, Homo sapiens
gcgaggggcagggcugc

SEQ ID NO: 44867 - RNA, 17 nt, Homo sapiens
ucaucaguuagguuggu

SEQ ID NO: 44868 - RNA, 17 nt, Homo sapiens
uggaggauuuggacaaa

SEQ ID NO: 44869 - RNA, 22 nt, Homo sapiens
agggugcagaugggaaagcuga

SEQ ID NO: 44870 - RNA, 20 nt, Homo sapiens
agugucucuccagugguucu

SEQ ID NO: 44871 - RNA, 21 nt, Homo sapiens
cagggcaccugcugugaccug

SEQ ID NO: 44872 - RNA, 15 nt, Homo sapiens
ccacaugccaguucu

SEQ ID NO: 44873 - RNA, 17 nt, Homo sapiens
ccucugcuccucuuguc

SEQ ID NO: 44874 - RNA, 15 nt, Homo sapiens
ccuguccucugcucc

SEQ ID NO: 44875 - RNA, 20 nt, Homo sapiens
cuccucuugucccuugcucc

SEQ ID NO: 44876 - RNA, 18 nt, Homo sapiens
gcccuuagggcccucuuc

SEQ ID NO: 44877 - RNA, 15 nt, Homo sapiens
gccuggggaccaccu

SEQ ID NO: 44878 - RNA, 23 nt, Homo sapiens
aggacacaauggggcgcggguug

SEQ ID NO: 44879 - RNA, 17 nt, Homo sapiens
ccugugcccagcaccug

SEQ ID NO: 44880 - RNA, 18 nt, Homo sapiens
cuccaacuccugaugggu

SEQ ID NO: 44881 - RNA, 19 nt, Homo sapiens
gcacaaacucagcuggggc

SEQ ID NO: 44882 - RNA, 20 nt, Homo sapiens
gggucccugucaaggcugcc

SEQ ID NO: 44883 - RNA, 18 nt, Homo sapiens
ucaagcaccgcggucugg

SEQ ID NO: 44884 - RNA, 17 nt, Homo sapiens
agguggcccccucucug

SEQ ID NO: 44885 - RNA, 22 nt, Homo sapiens
cccaguguugaaccccagcgug

SEQ ID NO: 44886 - RNA, 20 nt, Homo sapiens
cgcagagcaacaugaagcua

SEQ ID NO: 44887 - RNA, 18 nt, Homo sapiens
cgggggggcucaggugga

SEQ ID NO: 44888 - RNA, 16 nt, Homo sapiens
gauggucuggagcucg

SEQ ID NO: 44889 - RNA, 20 nt, Homo sapiens
gccucugggagggucucuuc

SEQ ID NO: 44890 - RNA, 19 nt, Homo sapiens
gcucuaauuagguaacagg

SEQ ID NO: 44891 - RNA, 17 nt, Homo sapiens
guccaugguacuugcug

SEQ ID NO: 44892 - RNA, 20 nt, Homo sapiens
uaaagcuuugauucauagac

SEQ ID NO: 44893 - RNA, 18 nt, Homo sapiens
uccccccuuccacuucuc

SEQ ID NO: 44894 - RNA, 24 nt, Homo sapiens
ucugcaacgcccauguccaggcac

SEQ ID NO: 44895 - RNA, 22 nt, Homo sapiens
ucugugcugccccacguuggac

SEQ ID NO: 44896 - RNA, 16 nt, Homo sapiens
ucuguuuucauguucu

SEQ ID NO: 44897 - RNA, 21 nt, Homo sapiens
ugggaggaagccaugccuggc

SEQ ID NO: 44898 - RNA, 21 nt, Homo sapiens
agcaaacaaaauagcccugug

SEQ ID NO: 44899 - RNA, 19 nt, Homo sapiens
agcaggccaaggacugcuc

SEQ ID NO: 44900 - RNA, 17 nt, Homo sapiens
agccaggcgucugggga

SEQ ID NO: 44901 - RNA, 17 nt, Homo sapiens
caacggugggggagggg

SEQ ID NO: 44902 - RNA, 19 nt, Homo sapiens
cagcagccaggcgucuggg

SEQ ID NO: 44903 - RNA, 18 nt, Homo sapiens
cagggcacuggcugccug

SEQ ID NO: 44904 - RNA, 17 nt, Homo sapiens
ccccuugggagcagacc

SEQ ID NO: 44905 - RNA, 16 nt, Homo sapiens
ggggagggagggggag

SEQ ID NO: 44906 - RNA, 21 nt, Homo sapiens
ucgagugugagccaaguuaga

SEQ ID NO: 44907 - RNA, 20 nt, Homo sapiens
ugccuggccuggguggggcu

SEQ ID NO: 44908 - RNA, 23 nt, Homo sapiens
uggggagaagguagagaugcugc

SEQ ID NO: 44909 - RNA, 22 nt, Homo sapiens
aaagguacuggccucggaggaa

SEQ ID NO: 44910 - RNA, 16 nt, Homo sapiens
gcuggggcagcuggcc

SEQ ID NO: 44911 - RNA, 21 nt, Homo sapiens
aagugaggggagaagaggagg

SEQ ID NO: 44912 - RNA, 18 nt, Homo sapiens
agaagaggaggaauaaga

SEQ ID NO: 44913 - RNA, 20 nt, Homo sapiens
uacuauguaucuugacugua

SEQ ID NO: 44914 - RNA, 22 nt, Homo sapiens
aaaggggaggaaaaaggaaaaa

SEQ ID NO: 44915 - RNA, 19 nt, Homo sapiens
acuuuuauggagacacaca

SEQ ID NO: 44916 - RNA, 19 nt, Homo sapiens
cagcggcugcugcuuggca

SEQ ID NO: 44917 - RNA, 21 nt, Homo sapiens
caggcuaaucucuguggaagc

SEQ ID NO: 44918 - RNA, 18 nt, Homo sapiens
caguucuacaguaguacu

SEQ ID NO: 44919 - RNA, 18 nt, Homo sapiens
ccuccccguguucucucc

SEQ ID NO: 44920 - RNA, 23 nt, Homo sapiens
cgaucggaaucgugggaucuucc

SEQ ID NO: 44921 - RNA, 19 nt, Homo sapiens
gccgccuccuugguguggu

SEQ ID NO: 44922 - RNA, 22 nt, Homo sapiens
gcggcugcugcuuggcagucga

SEQ ID NO: 44923 - RNA, 15 nt, Homo sapiens
guggaggugagggga

SEQ ID NO: 44924 - RNA, 20 nt, Homo sapiens
ucucucacgugcuucagugg

SEQ ID NO: 44925 - RNA, 22 nt, Homo sapiens
augcagaugguggugggaacgg

SEQ ID NO: 44926 - RNA, 19 nt, Homo sapiens
ccgccgcggguccagccgg

SEQ ID NO: 44927 - RNA, 15 nt, Homo sapiens
ccgcggguccagccg

SEQ ID NO: 44928 - RNA, 21 nt, Homo sapiens
cgcgggcgcuggagcggaggc

SEQ ID NO: 44929 - RNA, 18 nt, Homo sapiens
cggcgcgggcgcuggagc

SEQ ID NO: 44930 - RNA, 22 nt, Homo sapiens
gggcacggcgcgggcgcuggag

SEQ ID NO: 44931 - RNA, 18 nt, Homo sapiens
uuagcaguggugacaguu

SEQ ID NO: 44932 - RNA, 24 nt, Homo sapiens
aagcacacaguauaucagauucca

SEQ ID NO: 44933 - RNA, 20 nt, Homo sapiens
cuuuagguguaggggagggg

SEQ ID NO: 44934 - RNA, 19 nt, Homo sapiens
gaagauagauaggacacau

SEQ ID NO: 44935 - RNA, 16 nt, Homo sapiens
gcagaagaguucagga

SEQ ID NO: 44936 - RNA, 18 nt, Homo sapiens
aaccggauucuacagcau

SEQ ID NO: 44937 - RNA, 23 nt, Homo sapiens
agauuguuuucuauggggcugga

SEQ ID NO: 44938 - RNA, 18 nt, Homo sapiens
cacaaacauccccacaug

SEQ ID NO: 44939 - RNA, 19 nt, Homo sapiens
cggcagaugggcccugccc

SEQ ID NO: 44940 - RNA, 20 nt, Homo sapiens
cuggaaagcccggccugagc

SEQ ID NO: 44941 - RNA, 17 nt, Homo sapiens
ggggcugcgccgcgagg

SEQ ID NO: 44942 - RNA, 16 nt, Homo sapiens
ucggugcagaugggua

SEQ ID NO: 44943 - RNA, 18 nt, Homo sapiens
ugaaaaaaaaaaaaaagg

SEQ ID NO: 44944 - RNA, 18 nt, Homo sapiens
ugaaauggugaguuuucc

SEQ ID NO: 44945 - RNA, 20 nt, Homo sapiens
ugggcggccggcaggcagca

SEQ ID NO: 44946 - RNA, 19 nt, Homo sapiens
gaaaaaaagauguagcaaa

SEQ ID NO: 44947 - RNA, 18 nt, Homo sapiens
gagagcacagcuguccug

SEQ ID NO: 44948 - RNA, 21 nt, Homo sapiens
agaggagggggcgccgggaag

SEQ ID NO: 44949 - RNA, 21 nt, Homo sapiens
ugaaaauaaauacaguccaug

SEQ ID NO: 44950 - RNA, 17 nt, Homo sapiens
ugggaggagaggagggg

SEQ ID NO: 44951 - RNA, 19 nt, Homo sapiens
cagcugguaucccccaggg

SEQ ID NO: 44952 - RNA, 19 nt, Homo sapiens
caggauccucccagccccc

SEQ ID NO: 44953 - RNA, 20 nt, Homo sapiens
cagcggcuccuggcugcggc

SEQ ID NO: 44954 - RNA, 16 nt, Homo sapiens
ccuggcugcggcggcg

SEQ ID NO: 44955 - RNA, 25 nt, Homo sapiens
ugcagcggcuccuggcugcggcggc

SEQ ID NO: 44956 - RNA, 20 nt, Homo sapiens
cagucgcacaauccuggcuc

SEQ ID NO: 44957 - RNA, 18 nt, Homo sapiens
aagcgucgggcagccgcg

SEQ ID NO: 44958 - RNA, 18 nt, Homo sapiens
ggagcccucggcuggagc

SEQ ID NO: 44959 - RNA, 22 nt, Homo sapiens
acaaucuuuuuguauacuacca

SEQ ID NO: 44960 - RNA, 18 nt, Homo sapiens
acagaagcuuccccuccc

SEQ ID NO: 44961 - RNA, 19 nt, Homo sapiens
acaguuccauggcaggguu

SEQ ID NO: 44962 - RNA, 16 nt, Homo sapiens
agcuuggaauaggaag

SEQ ID NO: 44963 - RNA, 17 nt, Homo sapiens
aucaagcacuguccugc

SEQ ID NO: 44964 - RNA, 18 nt, Homo sapiens
cggcggggugagcggcuc

SEQ ID NO: 44965 - RNA, 21 nt, Homo sapiens
cugcugcugcugcugcugccg

SEQ ID NO: 44966 - RNA, 19 nt, Homo sapiens
gcccuguagccucuuccau

SEQ ID NO: 44967 - RNA, 17 nt, Homo sapiens
gccgagggcgagucgga

SEQ ID NO: 44968 - RNA, 17 nt, Homo sapiens
gccgggacuggcggcgg

SEQ ID NO: 44969 - RNA, 19 nt, Homo sapiens
ggaagcuuggaauaggaag

SEQ ID NO: 44970 - RNA, 18 nt, Homo sapiens
ggggcucgugcggcagcg

SEQ ID NO: 44971 - RNA, 19 nt, Homo sapiens
ucguggggcucgugcggca

SEQ ID NO: 44972 - RNA, 21 nt, Homo sapiens
ucucuuuuauuccccuguaca

SEQ ID NO: 44973 - RNA, 19 nt, Homo sapiens
ugaaggagggggugaggga

SEQ ID NO: 44974 - RNA, 20 nt, Homo sapiens
uggcggcgggagggcgcgcc

SEQ ID NO: 44975 - RNA, 16 nt, Homo sapiens
ugucacugguacucgg

SEQ ID NO: 44976 - RNA, 22 nt, Homo sapiens
uuugugcauuuuuugugugugu

SEQ ID NO: 44977 - RNA, 17 nt, Homo sapiens
aggggguaauaaaggga

SEQ ID NO: 44978 - RNA, 20 nt, Homo sapiens
auacauucaucuguaaauaa

SEQ ID NO: 44979 - RNA, 22 nt, Homo sapiens
uucacugugcaggccacacauu

SEQ ID NO: 44980 - RNA, 15 nt, Homo sapiens
cugauuuugccccca

SEQ ID NO: 44981 - RNA, 23 nt, Homo sapiens
gugcuauuauucccaaaaggcug

SEQ ID NO: 44982 - RNA, 18 nt, Homo sapiens
ucaucucagcuuccugug

SEQ ID NO: 44983 - RNA, 21 nt, Homo sapiens
uggggaaucugaagucuuguu

SEQ ID NO: 44984 - RNA, 19 nt, Homo sapiens
uuuaacuuuauuuuaagcu

SEQ ID NO: 44985 - RNA, 25 nt, Homo sapiens
uuucuggcuuugccaaaaauaaaaa

SEQ ID NO: 44986 - RNA, 17 nt, Homo sapiens
accucaacagcagcaga

SEQ ID NO: 44987 - RNA, 20 nt, Homo sapiens
agguggcggggccggcgcgg

SEQ ID NO: 44988 - RNA, 19 nt, Homo sapiens
augcuguggugaauuuugg

SEQ ID NO: 44989 - RNA, 22 nt, Homo sapiens
ccgcucggcucgcgcuccuccg

SEQ ID NO: 44990 - RNA, 21 nt, Homo sapiens
ggagugcauguaagcacaaau

SEQ ID NO: 44991 - RNA, 19 nt, Homo sapiens
gguuuccuggacgcgcucg

SEQ ID NO: 44992 - RNA, 18 nt, Homo sapiens
gugggggcugcagugggg

SEQ ID NO: 44993 - RNA, 19 nt, Homo sapiens
uaaagauuucaugucuuca

SEQ ID NO: 44994 - RNA, 17 nt, Homo sapiens
ucccgaagguggcgggg

SEQ ID NO: 44995 - RNA, 23 nt, Homo sapiens
uggcggggccggcgcgggcagga

SEQ ID NO: 44996 - RNA, 18 nt, Homo sapiens
ugugcugucucacgcugc

SEQ ID NO: 44997 - RNA, 17 nt, Homo sapiens
cauacaucuccugggga

SEQ ID NO: 44998 - RNA, 17 nt, Homo sapiens
ccacagggaaccaaucu

SEQ ID NO: 44999 - RNA, 18 nt, Homo sapiens
gaagagagagacaaagag

SEQ ID NO: 45000 - RNA, 19 nt, Homo sapiens
gguugacucccccagcuca

SEQ ID NO: 45001 - RNA, 18 nt, Homo sapiens
gauggguauguuucaggg

SEQ ID NO: 45002 - RNA, 21 nt, Homo sapiens
gggaggaugccuugagccaag

SEQ ID NO: 45003 - RNA, 20 nt, Homo sapiens
uacugaaucagcuuugaugu

SEQ ID NO: 45004 - RNA, 18 nt, Homo sapiens
ugagccaaggaggucaau

SEQ ID NO: 45005 - RNA, 17 nt, Homo sapiens
ugggaggaugccuugag

SEQ ID NO: 45006 - RNA, 24 nt, Homo sapiens
uguguuguugaaucaacuuuuagu

SEQ ID NO: 45007 - RNA, 18 nt, Homo sapiens
aaguuuuucacaacugcc

SEQ ID NO: 45008 - RNA, 14 nt, Homo sapiens
aauggacacugcag

SEQ ID NO: 45009 - RNA, 19 nt, Homo sapiens
ccuccugcuccccccggcc

SEQ ID NO: 45010 - RNA, 21 nt, Homo sapiens
ccucucccucuucugaccugc

SEQ ID NO: 45011 - RNA, 14 nt, Homo sapiens
ccugcuccccccgg

SEQ ID NO: 45012 - RNA, 20 nt, Homo sapiens
gaggagggcggugguguggg

SEQ ID NO: 45013 - RNA, 19 nt, Homo sapiens
ggacacugcagagacugaa

SEQ ID NO: 45014 - RNA, 18 nt, Homo sapiens
ggagaaagaaagaguggu

SEQ ID NO: 45015 - RNA, 21 nt, Homo sapiens
gggcagcguguggccuguggg

SEQ ID NO: 45016 - RNA, 17 nt, Homo sapiens
ggggagggaguccaaga

SEQ ID NO: 45017 - RNA, 24 nt, Homo sapiens
uccuauccuagugggugagacugg

SEQ ID NO: 45018 - RNA, 22 nt, Homo sapiens
ugagacugguggggaggauugu

SEQ ID NO: 45019 - RNA, 17 nt, Homo sapiens
ccuuugggccugugacg

SEQ ID NO: 45020 - RNA, 19 nt, Homo sapiens
gagggaugcuggagcugag

SEQ ID NO: 45021 - RNA, 22 nt, Homo sapiens
gggccugugacguggucccucg

SEQ ID NO: 45022 - RNA, 21 nt, Homo sapiens
aacacaaaucacacaacauua

SEQ ID NO: 45023 - RNA, 19 nt, Homo sapiens
aggcaacccaggcagagcu

SEQ ID NO: 45024 - RNA, 14 nt, Homo sapiens
aggccacaccugga

SEQ ID NO: 45025 - RNA, 19 nt, Homo sapiens
cauugguaauuacuaccua

SEQ ID NO: 45026 - RNA, 22 nt, Homo sapiens
cccagcauuuccauccacuugc

SEQ ID NO: 45027 - RNA, 18 nt, Homo sapiens
ccggagagucguccucac

SEQ ID NO: 45028 - RNA, 16 nt, Homo sapiens
ccucuggcagcccagc

SEQ ID NO: 45029 - RNA, 19 nt, Homo sapiens
ccuuguuaguuucuucgua

SEQ ID NO: 45030 - RNA, 17 nt, Homo sapiens
cugugauggucuauucc

SEQ ID NO: 45031 - RNA, 23 nt, Homo sapiens
gaaaguucucuaucagacagcuu

SEQ ID NO: 45032 - RNA, 16 nt, Homo sapiens
uccugugccugcaaac

SEQ ID NO: 45033 - RNA, 22 nt, Homo sapiens
ugaggacgugcacagggccugg

SEQ ID NO: 45034 - RNA, 21 nt, Homo sapiens
uuccuuguccugaugccacau

SEQ ID NO: 45035 - RNA, 19 nt, Homo sapiens
uuggauaauaguuaacaga

SEQ ID NO: 45036 - RNA, 16 nt, Homo sapiens
uuuuuuccucugacuc

SEQ ID NO: 45037 - RNA, 20 nt, Homo sapiens
uagcaaaaugggcuuuggau

SEQ ID NO: 45038 - RNA, 18 nt, Homo sapiens
ucuagaauacugaaauac

SEQ ID NO: 45039 - RNA, 17 nt, Homo sapiens
aggaagauaagaggaag

SEQ ID NO: 45040 - RNA, 16 nt, Homo sapiens
gccuguuccauauccc

SEQ ID NO: 45041 - RNA, 21 nt, Homo sapiens
aaggaaaaaaaucaguuugcc

SEQ ID NO: 45042 - RNA, 17 nt, Homo sapiens
gcgccagcgccggcgcc

SEQ ID NO: 45043 - RNA, 27 nt, Homo sapiens
acuaguguuucauuuccuagaggugua

SEQ ID NO: 45044 - RNA, 15 nt, Homo sapiens
agggcuauccaaagc

SEQ ID NO: 45045 - RNA, 17 nt, Homo sapiens
caccauucucauggaag

SEQ ID NO: 45046 - RNA, 21 nt, Homo sapiens
cacucuggcucgcugggcgcc

SEQ ID NO: 45047 - RNA, 22 nt, Homo sapiens
cauggggauguaucgacaugaa

SEQ ID NO: 45048 - RNA, 18 nt, Homo sapiens
cgguggcgggucugggcg

SEQ ID NO: 45049 - RNA, 20 nt, Homo sapiens
gccgggucgggugggcucug

SEQ ID NO: 45050 - RNA, 18 nt, Homo sapiens
gcgguggcgggucugggc

SEQ ID NO: 45051 - RNA, 17 nt, Homo sapiens
gcgucgggccgggucgg

SEQ ID NO: 45052 - RNA, 15 nt, Homo sapiens
ggcucuggcggccug

SEQ ID NO: 45053 - RNA, 17 nt, Homo sapiens
gguccgggugcgguggc

SEQ ID NO: 45054 - RNA, 26 nt, Homo sapiens
ggucgggugggcucuggcggccuggg

SEQ ID NO: 45055 - RNA, 18 nt, Homo sapiens
gugggcucuggcggccug

SEQ ID NO: 45056 - RNA, 17 nt, Homo sapiens
uggcgcggccggcagca

SEQ ID NO: 45057 - RNA, 21 nt, Homo sapiens
aggcaggcgcgauggugggag

SEQ ID NO: 45058 - RNA, 18 nt, Homo sapiens
aggcaggcgcugcuuuga

SEQ ID NO: 45059 - RNA, 23 nt, Homo sapiens
aggcggcgcggcgauugcggcgg

SEQ ID NO: 45060 - RNA, 18 nt, Homo sapiens
cagagagggcaggaaugg

SEQ ID NO: 45061 - RNA, 19 nt, Homo sapiens
cccaugccucccaccucgg

SEQ ID NO: 45062 - RNA, 15 nt, Homo sapiens
ccuccucgggcccgg

SEQ ID NO: 45063 - RNA, 19 nt, Homo sapiens
gauuacaggcaugcgccac

SEQ ID NO: 45064 - RNA, 21 nt, Homo sapiens
gccuuggcaauccuuuuccuc

SEQ ID NO: 45065 - RNA, 21 nt, Homo sapiens
gcggcgcggcgauugcggcgg

SEQ ID NO: 45066 - RNA, 20 nt, Homo sapiens
ggcugcuguuggagaaggcg

SEQ ID NO: 45067 - RNA, 18 nt, Homo sapiens
ucccacagaagcccccgc

SEQ ID NO: 45068 - RNA, 19 nt, Homo sapiens
ugauuccaugguguggccu

SEQ ID NO: 45069 - RNA, 20 nt, Homo sapiens
ugccuggagagaagagggag

SEQ ID NO: 45070 - RNA, 22 nt, Homo sapiens
uuccaugguguggccugaguca

SEQ ID NO: 45071 - RNA, 19 nt, Homo sapiens
ccucgccucagccccgccc

SEQ ID NO: 45072 - RNA, 16 nt, Homo sapiens
acaaaaucacccaaaa

SEQ ID NO: 45073 - RNA, 15 nt, Homo sapiens
acccuuggggcgggc

SEQ ID NO: 45074 - RNA, 21 nt, Homo sapiens
agaagaucagcauuuuagaau

SEQ ID NO: 45075 - RNA, 18 nt, Homo sapiens
agagguucgagaucagcc

SEQ ID NO: 45076 - RNA, 22 nt, Homo sapiens
aggaacaagacagauauguugg

SEQ ID NO: 45077 - RNA, 21 nt, Homo sapiens
agguucgagaucagccugggc

SEQ ID NO: 45078 - RNA, 19 nt, Homo sapiens
caaucuuccgcucugggag

SEQ ID NO: 45079 - RNA, 21 nt, Homo sapiens
cacgaccggcucguccacuug

SEQ ID NO: 45080 - RNA, 14 nt, Homo sapiens
caguggcucaggcc

SEQ ID NO: 45081 - RNA, 21 nt, Homo sapiens
cggacugcgggcgggcgucuc

SEQ ID NO: 45082 - RNA, 18 nt, Homo sapiens
cuaccugugacaagagca

SEQ ID NO: 45083 - RNA, 20 nt, Homo sapiens
gcccuuggggggcuggcugc

SEQ ID NO: 45084 - RNA, 18 nt, Homo sapiens
gccugcgcggagcuggcc

SEQ ID NO: 45085 - RNA, 19 nt, Homo sapiens
uauagucccagcuacuugg

SEQ ID NO: 45086 - RNA, 23 nt, Homo sapiens
uguuaagcaguuuguuugcauuu

SEQ ID NO: 45087 - RNA, 22 nt, Homo sapiens
acauaaauauauauguauauau

SEQ ID NO: 45088 - RNA, 18 nt, Homo sapiens
auauauauguauauauag

SEQ ID NO: 45089 - RNA, 20 nt, Homo sapiens
auauugauuuugauuuacuc

SEQ ID NO: 45090 - RNA, 21 nt, Homo sapiens
aucugaaccaaauagaaugcu

SEQ ID NO: 45091 - RNA, 21 nt, Homo sapiens
augauaauaaacauaaaagac

SEQ ID NO: 45092 - RNA, 20 nt, Homo sapiens
augauauugaaaaacagaaa

SEQ ID NO: 45093 - RNA, 20 nt, Homo sapiens
cauaaggaggcugucacaga

SEQ ID NO: 45094 - RNA, 18 nt, Homo sapiens
cccuucaguauaugcauc

SEQ ID NO: 45095 - RNA, 18 nt, Homo sapiens
ccgcggcugcggggcugg

SEQ ID NO: 45096 - RNA, 20 nt, Homo sapiens
cgccgggucuucuccccggg

SEQ ID NO: 45097 - RNA, 19 nt, Homo sapiens
ggacugugggggaugggga

SEQ ID NO: 45098 - RNA, 25 nt, Homo sapiens
uacauaaauauauauguauauauau

SEQ ID NO: 45099 - RNA, 24 nt, Homo sapiens
uccugcguagccaggccgcccgac

SEQ ID NO: 45100 - RNA, 19 nt, Homo sapiens
ugaaauacccucucuuuag

SEQ ID NO: 45101 - RNA, 16 nt, Homo sapiens
ugauagcagagcucug

SEQ ID NO: 45102 - RNA, 19 nt, Homo sapiens
uuucauggaaguauaucua

SEQ ID NO: 45103 - RNA, 14 nt, Homo sapiens
acacuuucugggga

SEQ ID NO: 45104 - RNA, 21 nt, Homo sapiens
agaaggcacugucacccccca

SEQ ID NO: 45105 - RNA, 21 nt, Homo sapiens
aggggauugcacaguuuauuu

SEQ ID NO: 45106 - RNA, 16 nt, Homo sapiens
auggaggucccgaggg

SEQ ID NO: 45107 - RNA, 18 nt, Homo sapiens
gaggagacggccacagcc

SEQ ID NO: 45108 - RNA, 20 nt, Homo sapiens
gaggagcauggagggugggg

SEQ ID NO: 45109 - RNA, 20 nt, Homo sapiens
gguggcucagcaggguggag

SEQ ID NO: 45110 - RNA, 22 nt, Homo sapiens
ucuacaccccuggauuacacug

SEQ ID NO: 45111 - RNA, 21 nt, Homo sapiens
ugaggagcauggagggugggg

SEQ ID NO: 45112 - RNA, 20 nt, Homo sapiens
uggagauggaggucccgagg

SEQ ID NO: 45113 - RNA, 18 nt, Homo sapiens
ccuccagcuccauccaug

SEQ ID NO: 45114 - RNA, 18 nt, Homo sapiens
gaguaagcagaaugucug

SEQ ID NO: 45115 - RNA, 19 nt, Homo sapiens
uacucccaggagccccaug

SEQ ID NO: 45116 - RNA, 18 nt, Homo sapiens
uccacuggaugugccacu

SEQ ID NO: 45117 - RNA, 23 nt, Homo sapiens
aagaauguuaggguggcuggaaa

SEQ ID NO: 45118 - RNA, 19 nt, Homo sapiens
caguaaucuuuuuccaaac

SEQ ID NO: 45119 - RNA, 16 nt, Homo sapiens
ggagugugauaggugg

SEQ ID NO: 45120 - RNA, 17 nt, Homo sapiens
aggggucugggggaccc

SEQ ID NO: 45121 - RNA, 17 nt, Homo sapiens
caccccgguggggcccc

SEQ ID NO: 45122 - RNA, 24 nt, Homo sapiens
cccugaacauggagcgggucccag

SEQ ID NO: 45123 - RNA, 18 nt, Homo sapiens
gccuccaucuccaccccg

SEQ ID NO: 45124 - RNA, 18 nt, Homo sapiens
guggucuggcaggagucc

SEQ ID NO: 45125 - RNA, 19 nt, Homo sapiens
ugauuaaaggaaccugacg

SEQ ID NO: 45126 - RNA, 19 nt, Homo sapiens
ugcaauguuggggaagcug

SEQ ID NO: 45127 - RNA, 22 nt, Homo sapiens
ugcuuggauuggcuggugggga

SEQ ID NO: 45128 - RNA, 22 nt, Homo sapiens
uguggcucagggccacguggug

SEQ ID NO: 45129 - RNA, 18 nt, Homo sapiens
ugugucuggcuuccugcc

SEQ ID NO: 45130 - RNA, 19 nt, Homo sapiens
ggccgccgcagauguucuc

SEQ ID NO: 45131 - RNA, 16 nt, Homo sapiens
agcgauccacacacuc

SEQ ID NO: 45132 - RNA, 21 nt, Homo sapiens
uacccugagcuccccuccccc

SEQ ID NO: 45133 - RNA, 18 nt, Homo sapiens
cggggagggaacacaggu

SEQ ID NO: 45134 - RNA, 19 nt, Homo sapiens
ggggugggcugucucucca

SEQ ID NO: 45135 - RNA, 18 nt, Homo sapiens
uggaacaggaaagaugau

SEQ ID NO: 45136 - RNA, 20 nt, Homo sapiens
ggcagccccaagccaggccc

SEQ ID NO: 45137 - RNA, 20 nt, Homo sapiens
gggaggagggaggcagggca

SEQ ID NO: 45138 - RNA, 17 nt, Homo sapiens
aggggaaacagggcugg

SEQ ID NO: 45139 - RNA, 23 nt, Homo sapiens
aggggaaggagacgagaguggga

SEQ ID NO: 45140 - RNA, 16 nt, Homo sapiens
aggggcguggccccca

SEQ ID NO: 45141 - RNA, 21 nt, Homo sapiens
aguggagugggacggagggag

SEQ ID NO: 45142 - RNA, 19 nt, Homo sapiens
agugggaggggaggggcgg

SEQ ID NO: 45143 - RNA, 22 nt, Homo sapiens
agugggaggggaggggcggcag

SEQ ID NO: 45144 - RNA, 17 nt, Homo sapiens
caacccuggucugcuuc

SEQ ID NO: 45145 - RNA, 20 nt, Homo sapiens
caggacccucugugcccaca

SEQ ID NO: 45146 - RNA, 20 nt, Homo sapiens
ccagcuggggcugcagcccc

SEQ ID NO: 45147 - RNA, 21 nt, Homo sapiens
cgguggggcagcccugguucc

SEQ ID NO: 45148 - RNA, 20 nt, Homo sapiens
cugucucugcauacuuuguu

SEQ ID NO: 45149 - RNA, 20 nt, Homo sapiens
gcagcuagagugcuaagagg

SEQ ID NO: 45150 - RNA, 16 nt, Homo sapiens
gcccuggagugggcag

SEQ ID NO: 45151 - RNA, 21 nt, Homo sapiens
gcgggguggaagggucaggag

SEQ ID NO: 45152 - RNA, 20 nt, Homo sapiens
ggaacccagugauuuuaugg

SEQ ID NO: 45153 - RNA, 24 nt, Homo sapiens
ggaggaagggaagcagggcagggg

SEQ ID NO: 45154 - RNA, 20 nt, Homo sapiens
ggagggcuggcacagcccgg

SEQ ID NO: 45155 - RNA, 19 nt, Homo sapiens
ggcggcagacggcgggcgg

SEQ ID NO: 45156 - RNA, 20 nt, Homo sapiens
gggagaguggggggccaggg

SEQ ID NO: 45157 - RNA, 18 nt, Homo sapiens
gggaggggcggcaguggg

SEQ ID NO: 45158 - RNA, 18 nt, Homo sapiens
gggcggcaguggggagga

SEQ ID NO: 45159 - RNA, 15 nt, Homo sapiens
gggcucaggagacuc

SEQ ID NO: 45160 - RNA, 21 nt, Homo sapiens
gggcugggagggcuggcacag

SEQ ID NO: 45161 - RNA, 17 nt, Homo sapiens
ggggaggagggggcugg

SEQ ID NO: 45162 - RNA, 18 nt, Homo sapiens
ggggaggagugacgggag

SEQ ID NO: 45163 - RNA, 18 nt, Homo sapiens
ggggaggggcggcagugg

SEQ ID NO: 45164 - RNA, 25 nt, Homo sapiens
ggggaggggcggcaguggggaggag

SEQ ID NO: 45165 - RNA, 19 nt, Homo sapiens
ugcauacuuuguuuuguuc

SEQ ID NO: 45166 - RNA, 25 nt, Homo sapiens
ugccuggggaaaggcuggagagaga

SEQ ID NO: 45167 - RNA, 18 nt, Homo sapiens
ugggaggggaggggcggc

SEQ ID NO: 45168 - RNA, 16 nt, Homo sapiens
uggggcccugaggacc

SEQ ID NO: 45169 - RNA, 21 nt, Homo sapiens
acacacacaccgcccgccccc

SEQ ID NO: 45170 - RNA, 23 nt, Homo sapiens
agaggcuggaacagacccuuccc

SEQ ID NO: 45171 - RNA, 16 nt, Homo sapiens
aggcagaagauaggca

SEQ ID NO: 45172 - RNA, 22 nt, Homo sapiens
aggccucacccacaaccuccca

SEQ ID NO: 45173 - RNA, 19 nt, Homo sapiens
cugcagcuguucugccugg

SEQ ID NO: 45174 - RNA, 19 nt, Homo sapiens
gagaaggggugggagggcc

SEQ ID NO: 45175 - RNA, 22 nt, Homo sapiens
gauggcuuuggucccugcauca

SEQ ID NO: 45176 - RNA, 22 nt, Homo sapiens
ggacagaggcugcuguggcuuc

SEQ ID NO: 45177 - RNA, 17 nt, Homo sapiens
gucccagccccaggagu

SEQ ID NO: 45178 - RNA, 24 nt, Homo sapiens
uccaaguggccaccugcaggcugg

SEQ ID NO: 45179 - RNA, 16 nt, Homo sapiens
ucccacugcccuaaac

SEQ ID NO: 45180 - RNA, 22 nt, Homo sapiens
uccccaucuccccaguuucccu

SEQ ID NO: 45181 - RNA, 18 nt, Homo sapiens
ucucuggaaccuaccaga

SEQ ID NO: 45182 - RNA, 23 nt, Homo sapiens
ugauggaguuuuagaaaaauuuu

SEQ ID NO: 45183 - RNA, 18 nt, Homo sapiens
uggccagauguagaaaau

SEQ ID NO: 45184 - RNA, 20 nt, Homo sapiens
caagccacuuuaagauaaaa

SEQ ID NO: 45185 - RNA, 20 nt, Homo sapiens
cagcagcccagaaauuaaca

SEQ ID NO: 45186 - RNA, 19 nt, Homo sapiens
ccaugagacccugguuucc

SEQ ID NO: 45187 - RNA, 17 nt, Homo sapiens
ccccaucccccuccccc

SEQ ID NO: 45188 - RNA, 15 nt, Homo sapiens
cccgccgccgccgcc

SEQ ID NO: 45189 - RNA, 15 nt, Homo sapiens
ccgccucccgcgggu

SEQ ID NO: 45190 - RNA, 16 nt, Homo sapiens
ccucgccgcuuccgcc

SEQ ID NO: 45191 - RNA, 23 nt, Homo sapiens
ccugcuguuuucugcccaaguuc

SEQ ID NO: 45192 - RNA, 18 nt, Homo sapiens
cgccgggguccgagccgg

SEQ ID NO: 45193 - RNA, 19 nt, Homo sapiens
cgccucccgcggguuaggc

SEQ ID NO: 45194 - RNA, 17 nt, Homo sapiens
cugcagauggcgggugg

SEQ ID NO: 45195 - RNA, 15 nt, Homo sapiens
gacgcccgccgcccu

SEQ ID NO: 45196 - RNA, 14 nt, Homo sapiens
gccggacgcccgcc

SEQ ID NO: 45197 - RNA, 19 nt, Homo sapiens
gggaacgcguguguccacc

SEQ ID NO: 45198 - RNA, 14 nt, Homo sapiens
guucuuuggggugg

SEQ ID NO: 45199 - RNA, 23 nt, Homo sapiens
uccagcugguuccauaaccacau

SEQ ID NO: 45200 - RNA, 17 nt, Homo sapiens
ucccaggcagccucagc

SEQ ID NO: 45201 - RNA, 20 nt, Homo sapiens
ucgugaguuuauugcauaug

SEQ ID NO: 45202 - RNA, 20 nt, Homo sapiens
gcggcggcggcggcggcgcc

SEQ ID NO: 45203 - RNA, 18 nt, Homo sapiens
gcggcugcggcggcggcg

SEQ ID NO: 45204 - RNA, 22 nt, Homo sapiens
aacauguaugaaaaauaaaaua

SEQ ID NO: 45205 - RNA, 16 nt, Homo sapiens
cugagccccccucccc

SEQ ID NO: 45206 - RNA, 18 nt, Homo sapiens
gauuccuggggaaugagc

SEQ ID NO: 45207 - RNA, 15 nt, Homo sapiens
gcgccgucggggcgc

SEQ ID NO: 45208 - RNA, 19 nt, Homo sapiens
ggagccuucuucuaauggc

SEQ ID NO: 45209 - RNA, 18 nt, Homo sapiens
ucaggcugcgauagcauu

SEQ ID NO: 45210 - RNA, 18 nt, Homo sapiens
agcuuugauuguguuguc

SEQ ID NO: 45211 - RNA, 18 nt, Homo sapiens
gcuuauugucugucugug

SEQ ID NO: 45212 - RNA, 17 nt, Homo sapiens
ucauaaagaugggagug

SEQ ID NO: 45213 - RNA, 21 nt, Homo sapiens
aguacaaucaagucaucccuc

SEQ ID NO: 45214 - RNA, 22 nt, Homo sapiens
agugagucucuuaaagacgcuu

SEQ ID NO: 45215 - RNA, 18 nt, Homo sapiens
acagacacgcccacugug

SEQ ID NO: 45216 - RNA, 18 nt, Homo sapiens
cagcggggagguggcagc

SEQ ID NO: 45217 - RNA, 19 nt, Homo sapiens
gggcccagcggggaggugg

SEQ ID NO: 45218 - RNA, 21 nt, Homo sapiens
uaaaaaaauacugucacaaua

SEQ ID NO: 45219 - RNA, 17 nt, Homo sapiens
uacagacacgcccacug

SEQ ID NO: 45220 - RNA, 17 nt, Homo sapiens
uccccugcaaugagcau

SEQ ID NO: 45221 - RNA, 18 nt, Homo sapiens
ugggagguuccagaugcu

SEQ ID NO: 45222 - RNA, 14 nt, Homo sapiens
gccugcucgguggu

SEQ ID NO: 45223 - RNA, 18 nt, Homo sapiens
ugcuccuccuccacccug

SEQ ID NO: 45224 - RNA, 19 nt, Homo sapiens
gcgaacgagggcgcggugg

SEQ ID NO: 45225 - RNA, 18 nt, Homo sapiens
ggcggcgguggcgcggac

SEQ ID NO: 45226 - RNA, 17 nt, Homo sapiens
gggcggcggcgguggcg

SEQ ID NO: 45227 - RNA, 22 nt, Homo sapiens
ggguguggguggugggagcgcg

SEQ ID NO: 45228 - RNA, 21 nt, Homo sapiens
ucuugcugguaauauauugcu

SEQ ID NO: 45229 - RNA, 18 nt, Homo sapiens
uuggauacuugcuggaaa

SEQ ID NO: 45230 - RNA, 17 nt, Homo sapiens
ucgcugggagcgcgcgc

SEQ ID NO: 45231 - RNA, 21 nt, Homo sapiens
ucgcugggagcgcgcgcuccg

SEQ ID NO: 45232 - RNA, 21 nt, Homo sapiens
aaacugcauuauuucccuugc

SEQ ID NO: 45233 - RNA, 22 nt, Homo sapiens
agccauggaugccucugcccug

SEQ ID NO: 45234 - RNA, 20 nt, Homo sapiens
cacagugugagaugagaggc

SEQ ID NO: 45235 - RNA, 16 nt, Homo sapiens
uaagucuacaugguua

SEQ ID NO: 45236 - RNA, 18 nt, Homo sapiens
aggggccggggcuggccu

SEQ ID NO: 45237 - RNA, 18 nt, Homo sapiens
gagggcuaggggccgggg

SEQ ID NO: 45238 - RNA, 15 nt, Homo sapiens
gcgguggcggcagca

SEQ ID NO: 45239 - RNA, 18 nt, Homo sapiens
aaggcgccagugaaggac

SEQ ID NO: 45240 - RNA, 19 nt, Homo sapiens
auguuuucgauuuucugca

SEQ ID NO: 45241 - RNA, 22 nt, Homo sapiens
cucugccucgcgauucuccgga

SEQ ID NO: 45242 - RNA, 20 nt, Homo sapiens
ggaggcaagguagggagagc

SEQ ID NO: 45243 - RNA, 16 nt, Homo sapiens
uccacagggucagcca

SEQ ID NO: 45244 - RNA, 21 nt, Homo sapiens
ucucuagggguuuggcuacug

SEQ ID NO: 45245 - RNA, 16 nt, Homo sapiens
ucugugcagauaccag

SEQ ID NO: 45246 - RNA, 18 nt, Homo sapiens
uucaagauuugcuguccc

SEQ ID NO: 45247 - RNA, 19 nt, Homo sapiens
acaaacacaaacacacacu

SEQ ID NO: 45248 - RNA, 21 nt, Homo sapiens
acagugaagucugcauguggc

SEQ ID NO: 45249 - RNA, 20 nt, Homo sapiens
agaaaaaaaaauaaaugaag

SEQ ID NO: 45250 - RNA, 15 nt, Homo sapiens
agcaggugugggggu

SEQ ID NO: 45251 - RNA, 18 nt, Homo sapiens
agcgacagguguguuccu

SEQ ID NO: 45252 - RNA, 19 nt, Homo sapiens
auggaucccaggagaugaa

SEQ ID NO: 45253 - RNA, 16 nt, Homo sapiens
cacguagugacagcug

SEQ ID NO: 45254 - RNA, 20 nt, Homo sapiens
cauucaugccugaagacauc

SEQ ID NO: 45255 - RNA, 20 nt, Homo sapiens
ccagggcaucaguugguuug

SEQ ID NO: 45256 - RNA, 22 nt, Homo sapiens
cucucucccucuuuccggccuu

SEQ ID NO: 45257 - RNA, 16 nt, Homo sapiens
gcgcgggggagcucgc

SEQ ID NO: 45258 - RNA, 22 nt, Homo sapiens
gcucgcccuucuuuucugcucc

SEQ ID NO: 45259 - RNA, 16 nt, Homo sapiens
ggacuucuguggucgu

SEQ ID NO: 45260 - RNA, 15 nt, Homo sapiens
ggagaaagagcagag

SEQ ID NO: 45261 - RNA, 18 nt, Homo sapiens
ggggugcggcgcggggga

SEQ ID NO: 45262 - RNA, 16 nt, Homo sapiens
gggugcggcgcggggg

SEQ ID NO: 45263 - RNA, 17 nt, Homo sapiens
guauucugauagguacc

SEQ ID NO: 45264 - RNA, 20 nt, Homo sapiens
gucuaacacugaugggauac

SEQ ID NO: 45265 - RNA, 17 nt, Homo sapiens
uaacacugaugggauac

SEQ ID NO: 45266 - RNA, 20 nt, Homo sapiens
uaggaagcaaagugcacuaa

SEQ ID NO: 45267 - RNA, 20 nt, Homo sapiens
ucccuauagugagacgaacc

SEQ ID NO: 45268 - RNA, 18 nt, Homo sapiens
ugaggccugggagaaaga

SEQ ID NO: 45269 - RNA, 21 nt, Homo sapiens
ugaggggcgccuggacacggc

SEQ ID NO: 45270 - RNA, 18 nt, Homo sapiens
uggccagccaugcagcag

SEQ ID NO: 45271 - RNA, 17 nt, Homo sapiens
uggcucaaugcccuuuu

SEQ ID NO: 45272 - RNA, 19 nt, Homo sapiens
uggucuguuaacaccuuuc

SEQ ID NO: 45273 - RNA, 18 nt, Homo sapiens
ugugugcauguguguguu

SEQ ID NO: 45274 - RNA, 18 nt, Homo sapiens
uugcuggguacucugaua

SEQ ID NO: 45275 - RNA, 21 nt, Homo sapiens
uuucuuuucuuucuuuacaga

SEQ ID NO: 45276 - RNA, 18 nt, Homo sapiens
auauaauagagguguaac

SEQ ID NO: 45277 - RNA, 19 nt, Homo sapiens
guguggaccgagagcggcu

SEQ ID NO: 45278 - RNA, 17 nt, Homo sapiens
uaccuuuaaaucauaua

SEQ ID NO: 45279 - RNA, 15 nt, Homo sapiens
ucacuaguguacagu

SEQ ID NO: 45280 - RNA, 17 nt, Homo sapiens
ucacuuaagauguaacu

SEQ ID NO: 45281 - RNA, 21 nt, Homo sapiens
ucuaaaaccacaaucagugac

SEQ ID NO: 45282 - RNA, 20 nt, Homo sapiens
ucucuuuuuuuuucuauauu

SEQ ID NO: 45283 - RNA, 15 nt, Homo sapiens
ugaaaguacaugcca

SEQ ID NO: 45284 - RNA, 20 nt, Homo sapiens
ggcaaggcguccgagaaagc

SEQ ID NO: 45285 - RNA, 22 nt, Homo sapiens
aagaaacagaaaagucacugug

SEQ ID NO: 45286 - RNA, 19 nt, Homo sapiens
aagcaggauguuggccaaa

SEQ ID NO: 45287 - RNA, 22 nt, Homo sapiens
aucacuuucguggagccaaucu

SEQ ID NO: 45288 - RNA, 18 nt, Homo sapiens
augggguucucuuguuau

SEQ ID NO: 45289 - RNA, 17 nt, Homo sapiens
auguuggccaaaguagg

SEQ ID NO: 45290 - RNA, 18 nt, Homo sapiens
caucauacuguucagcag

SEQ ID NO: 45291 - RNA, 18 nt, Homo sapiens
ccuuuggaacuguagacu

SEQ ID NO: 45292 - RNA, 17 nt, Homo sapiens
cuguucagcagcuaacu

SEQ ID NO: 45293 - RNA, 19 nt, Homo sapiens
gaguuguuguugccauuuc

SEQ ID NO: 45294 - RNA, 22 nt, Homo sapiens
ggcgaugacuacuuacacagcu

SEQ ID NO: 45295 - RNA, 19 nt, Homo sapiens
uauaaguuucucaagggaa

SEQ ID NO: 45296 - RNA, 18 nt, Homo sapiens
uaucacacacguagaagu

SEQ ID NO: 45297 - RNA, 20 nt, Homo sapiens
ucucauggacuuuagcugcu

SEQ ID NO: 45298 - RNA, 18 nt, Homo sapiens
uuucucagagcaacaaaa

SEQ ID NO: 45299 - RNA, 19 nt, Homo sapiens
agucugugggguggguggg

SEQ ID NO: 45300 - RNA, 19 nt, Homo sapiens
cugugcugccaggggccgg

SEQ ID NO: 45301 - RNA, 16 nt, Homo sapiens
uggagcugguguccac

SEQ ID NO: 45302 - RNA, 19 nt, Homo sapiens
agagaacagggugagcaga

SEQ ID NO: 45303 - RNA, 18 nt, Homo sapiens
ggaaacaaaggagaaaca

SEQ ID NO: 45304 - RNA, 20 nt, Homo sapiens
ggcugguggaggcagauuau

SEQ ID NO: 45305 - RNA, 23 nt, Homo sapiens
ggggauguucuugcugugugcuu

SEQ ID NO: 45306 - RNA, 19 nt, Homo sapiens
ucagugagguugcauugcc

SEQ ID NO: 45307 - RNA, 17 nt, Homo sapiens
ugaaauggaaacccaga

SEQ ID NO: 45308 - RNA, 26 nt, Homo sapiens
ugaauggggaggacuccugcuaugcu

SEQ ID NO: 45309 - RNA, 16 nt, Homo sapiens
ugcauuaucuucugcc

SEQ ID NO: 45310 - RNA, 16 nt, Homo sapiens
ugcuuugaacagggcc

SEQ ID NO: 45311 - RNA, 18 nt, Homo sapiens
uggaaaacuggcagccac

SEQ ID NO: 45312 - RNA, 18 nt, Homo sapiens
ugugcugcuuccuggcau

SEQ ID NO: 45313 - RNA, 18 nt, Homo sapiens
ugugucugugcugcuucc

SEQ ID NO: 45314 - RNA, 22 nt, Homo sapiens
uuaauguaguuuuuugagaaug

SEQ ID NO: 45315 - RNA, 19 nt, Homo sapiens
aaugacacaaaauaaagug

SEQ ID NO: 45316 - RNA, 17 nt, Homo sapiens
acaauuuagggacacaa

SEQ ID NO: 45317 - RNA, 20 nt, Homo sapiens
aucaugacaagugauuuauu

SEQ ID NO: 45318 - RNA, 19 nt, Homo sapiens
cauguaaacaccuagauua

SEQ ID NO: 45319 - RNA, 20 nt, Homo sapiens
cccacuucuugacaguguuc

SEQ ID NO: 45320 - RNA, 17 nt, Homo sapiens
gaugccagcacauaucu

SEQ ID NO: 45321 - RNA, 20 nt, Homo sapiens
uaaguggccuuaaguuugga

SEQ ID NO: 45322 - RNA, 17 nt, Homo sapiens
uaauaugcaauaauaaa

SEQ ID NO: 45323 - RNA, 14 nt, Homo sapiens
uccaguaguugucu

SEQ ID NO: 45324 - RNA, 16 nt, Homo sapiens
uguacaggaagauuuc

SEQ ID NO: 45325 - RNA, 14 nt, Homo sapiens
uguacaguaccauu

SEQ ID NO: 45326 - RNA, 17 nt, Homo sapiens
uguucguguaccaguau

SEQ ID NO: 45327 - RNA, 22 nt, Homo sapiens
uucuuacuaaaaugguguauua

SEQ ID NO: 45328 - RNA, 20 nt, Homo sapiens
uuucuugaugccagcacaua

SEQ ID NO: 45329 - RNA, 18 nt, Homo sapiens
ccacccaggaggagacag

SEQ ID NO: 45330 - RNA, 18 nt, Homo sapiens
cuucagggccugacuucg

SEQ ID NO: 45331 - RNA, 19 nt, Homo sapiens
gcucccggauggagaggcu

SEQ ID NO: 45332 - RNA, 16 nt, Homo sapiens
ggagucuggaagcucc

SEQ ID NO: 45333 - RNA, 19 nt, Homo sapiens
ucuccucuugacccgcccc

SEQ ID NO: 45334 - RNA, 22 nt, Homo sapiens
ucuguguuugcagcucuccuga

SEQ ID NO: 45335 - RNA, 17 nt, Homo sapiens
aggggagggagauggaa

SEQ ID NO: 45336 - RNA, 22 nt, Homo sapiens
agggggagucgggggcagaacc

SEQ ID NO: 45337 - RNA, 17 nt, Homo sapiens
aguuguggaugugcuga

SEQ ID NO: 45338 - RNA, 15 nt, Homo sapiens
gaggagaggagggag

SEQ ID NO: 45339 - RNA, 23 nt, Homo sapiens
gcugcccgcguccuggggccacc

SEQ ID NO: 45340 - RNA, 23 nt, Homo sapiens
ggacgugaggauuggaggauccg

SEQ ID NO: 45341 - RNA, 17 nt, Homo sapiens
ggcucagaaggggagaa

SEQ ID NO: 45342 - RNA, 19 nt, Homo sapiens
ggggcagggcggagggggu

SEQ ID NO: 45343 - RNA, 20 nt, Homo sapiens
guggaugugcugacugugga

SEQ ID NO: 45344 - RNA, 21 nt, Homo sapiens
ucagagaagaugggguuacag

SEQ ID NO: 45345 - RNA, 19 nt, Homo sapiens
ugaggagaggagggaggau

SEQ ID NO: 45346 - RNA, 23 nt, Homo sapiens
ugaggaggagggagacugagggg

SEQ ID NO: 45347 - RNA, 21 nt, Homo sapiens
ugauggcaguuguggaugugc

SEQ ID NO: 45348 - RNA, 19 nt, Homo sapiens
uggaggauccgagagaggc

SEQ ID NO: 45349 - RNA, 23 nt, Homo sapiens
cggcucacgucccgggcggaggg

SEQ ID NO: 45350 - RNA, 17 nt, Homo sapiens
ucccgggcggagggcgc

SEQ ID NO: 45351 - RNA, 19 nt, Homo sapiens
aaaagaauggagagcaaca

SEQ ID NO: 45352 - RNA, 19 nt, Homo sapiens
aaggagauacaauaucuuu

SEQ ID NO: 45353 - RNA, 22 nt, Homo sapiens
ccgccgcgcgcccuacgcgccg

SEQ ID NO: 45354 - RNA, 22 nt, Homo sapiens
cgcgcgcccuacgcgccgcucg

SEQ ID NO: 45355 - RNA, 17 nt, Homo sapiens
cuuuuauagcuugguuc

SEQ ID NO: 45356 - RNA, 21 nt, Homo sapiens
gccugggagcgggcccccgcc

SEQ ID NO: 45357 - RNA, 20 nt, Homo sapiens
ggagcgggccugggagcggg

SEQ ID NO: 45358 - RNA, 18 nt, Homo sapiens
uauuuccugauaucagau

SEQ ID NO: 45359 - RNA, 18 nt, Homo sapiens
uguaacugauauuacaac

SEQ ID NO: 45360 - RNA, 19 nt, Homo sapiens
uuccugauaucagauguag

SEQ ID NO: 45361 - RNA, 14 nt, Homo sapiens
cugauuccucgugc

SEQ ID NO: 45362 - RNA, 19 nt, Homo sapiens
cugcuccuugguguggauc

SEQ ID NO: 45363 - RNA, 19 nt, Homo sapiens
gcaaugcuccugcacccag

SEQ ID NO: 45364 - RNA, 15 nt, Homo sapiens
aggggcugugcccca

SEQ ID NO: 45365 - RNA, 17 nt, Homo sapiens
cagggugggaauggggu

SEQ ID NO: 45366 - RNA, 15 nt, Homo sapiens
uacccagugccuuuc

SEQ ID NO: 45367 - RNA, 18 nt, Homo sapiens
ucccgagcugggggcccc

SEQ ID NO: 45368 - RNA, 17 nt, Homo sapiens
aggggugcugaggccgg

SEQ ID NO: 45369 - RNA, 21 nt, Homo sapiens
cacaggaggaaaaaagccacu

SEQ ID NO: 45370 - RNA, 21 nt, Homo sapiens
cagcuuaugguagaccagggc

SEQ ID NO: 45371 - RNA, 23 nt, Homo sapiens
cgcagagcacaguccugcugcag

SEQ ID NO: 45372 - RNA, 18 nt, Homo sapiens
gcucggccccugcagugc

SEQ ID NO: 45373 - RNA, 18 nt, Homo sapiens
uccacucgcagagcacag

SEQ ID NO: 45374 - RNA, 18 nt, Homo sapiens
caggucccggaaacaagc

SEQ ID NO: 45375 - RNA, 18 nt, Homo sapiens
cauuccucaugagggugu

SEQ ID NO: 45376 - RNA, 16 nt, Homo sapiens
ccccugcaggcugcau

SEQ ID NO: 45377 - RNA, 23 nt, Homo sapiens
gaggggggaagcaggaugccagc

SEQ ID NO: 45378 - RNA, 22 nt, Homo sapiens
gcaggaagucuauggcaggaag

SEQ ID NO: 45379 - RNA, 25 nt, Homo sapiens
ggaaagguucaaaguccccacaaag

SEQ ID NO: 45380 - RNA, 24 nt, Homo sapiens
ugaaagggugggguggaggggucc

SEQ ID NO: 45381 - RNA, 18 nt, Homo sapiens
uggggucuccauagaaug

SEQ ID NO: 45382 - RNA, 24 nt, Homo sapiens
uguaagaucucuucgagagagcug

SEQ ID NO: 45383 - RNA, 19 nt, Homo sapiens
aacuugagcaagauaaaaa

SEQ ID NO: 45384 - RNA, 24 nt, Homo sapiens
agcuggggcaugaaaaugggcuug

SEQ ID NO: 45385 - RNA, 20 nt, Homo sapiens
ccgccgccgagcccccuccg

SEQ ID NO: 45386 - RNA, 20 nt, Homo sapiens
gcgccggcagucuccgcgcc

SEQ ID NO: 45387 - RNA, 16 nt, Homo sapiens
ucggaacccccgggac

SEQ ID NO: 45388 - RNA, 20 nt, Homo sapiens
ugaaauccacaacuggaaau

SEQ ID NO: 45389 - RNA, 14 nt, Homo sapiens
aguggaacaaggac

SEQ ID NO: 45390 - RNA, 20 nt, Homo sapiens
guauauucucccgugcaaua

SEQ ID NO: 45391 - RNA, 23 nt, Homo sapiens
uagcagacuaggguugccagauu

SEQ ID NO: 45392 - RNA, 15 nt, Homo sapiens
ugacaagacugggag

SEQ ID NO: 45393 - RNA, 20 nt, Homo sapiens
ugaugcuucaaauaucacau

SEQ ID NO: 45394 - RNA, 21 nt, Homo sapiens
ugggguccagacagagcucuc

SEQ ID NO: 45395 - RNA, 25 nt, Homo sapiens
uuauaacuauucaaucaaugauuca

SEQ ID NO: 45396 - RNA, 20 nt, Homo sapiens
cuguuagagcugccugggaa

SEQ ID NO: 45397 - RNA, 20 nt, Homo sapiens
uagcuuccagcggcaggugc

SEQ ID NO: 45398 - RNA, 20 nt, Homo sapiens
ugccugggaagaaggcgugc

SEQ ID NO: 45399 - RNA, 21 nt, Homo sapiens
ugccuuggggaacugggaaga

SEQ ID NO: 45400 - RNA, 16 nt, Homo sapiens
cagagcuuagauggaa

SEQ ID NO: 45401 - RNA, 18 nt, Homo sapiens
cuacauauuuuaccuguu

SEQ ID NO: 45402 - RNA, 21 nt, Homo sapiens
gagacugcuguggaaguuggu

SEQ ID NO: 45403 - RNA, 14 nt, Homo sapiens
gcaucuuugccagu

SEQ ID NO: 45404 - RNA, 22 nt, Homo sapiens
uaguacuuaucuacuacuauuu

SEQ ID NO: 45405 - RNA, 16 nt, Homo sapiens
ugugcauacugccuuu

SEQ ID NO: 45406 - RNA, 16 nt, Homo sapiens
agggaugugcagacgc

SEQ ID NO: 45407 - RNA, 18 nt, Homo sapiens
gcagggggauuuacuauu

SEQ ID NO: 45408 - RNA, 17 nt, Homo sapiens
ggcagaagcagcaggaa

SEQ ID NO: 45409 - RNA, 16 nt, Homo sapiens
ucagggcagcacagcc

SEQ ID NO: 45410 - RNA, 22 nt, Homo sapiens
ugagcgcggcgucucacaaccc

SEQ ID NO: 45411 - RNA, 15 nt, Homo sapiens
cccaucccgccuccc

SEQ ID NO: 45412 - RNA, 19 nt, Homo sapiens
ucaaguguuaugguugagu

SEQ ID NO: 45413 - RNA, 15 nt, Homo sapiens
uggcacgcagcgggc

SEQ ID NO: 45414 - RNA, 23 nt, Homo sapiens
acugguacuuggugugugugugu

SEQ ID NO: 45415 - RNA, 21 nt, Homo sapiens
gaacaggaaacagagugaggg

SEQ ID NO: 45416 - RNA, 24 nt, Homo sapiens
uucugcuucucaucaugggcaugu

SEQ ID NO: 45417 - RNA, 21 nt, Homo sapiens
aguaaccuggguccugaaucg

SEQ ID NO: 45418 - RNA, 18 nt, Homo sapiens
gagggaggaguagaaaca

SEQ ID NO: 45419 - RNA, 15 nt, Homo sapiens
ucuaccccaaaagag

SEQ ID NO: 45420 - RNA, 18 nt, Homo sapiens
aagaggggucuguagggu

SEQ ID NO: 45421 - RNA, 17 nt, Homo sapiens
agcgggagaggcacagc

SEQ ID NO: 45422 - RNA, 18 nt, Homo sapiens
aggcagcgucugggguug

SEQ ID NO: 45423 - RNA, 18 nt, Homo sapiens
ccaaagcccggauccucc

SEQ ID NO: 45424 - RNA, 18 nt, Homo sapiens
gagcugcgcccugugcug

SEQ ID NO: 45425 - RNA, 16 nt, Homo sapiens
ggcugggguuggagag

SEQ ID NO: 45426 - RNA, 17 nt, Homo sapiens
uggguuggauuggggag

SEQ ID NO: 45427 - RNA, 17 nt, Homo sapiens
uguguggggcagggccg

SEQ ID NO: 45428 - RNA, 19 nt, Homo sapiens
ugcccagguuguuaagcag

SEQ ID NO: 45429 - RNA, 23 nt, Homo sapiens
aaucauuugauagccaucauuuu

SEQ ID NO: 45430 - RNA, 19 nt, Homo sapiens
acuugaucaguacaaugua

SEQ ID NO: 45431 - RNA, 22 nt, Homo sapiens
auggagcccaaauucaacccuu

SEQ ID NO: 45432 - RNA, 19 nt, Homo sapiens
ccaggugcugggaaguuau

SEQ ID NO: 45433 - RNA, 19 nt, Homo sapiens
uagcagcugguguucaguc

SEQ ID NO: 45434 - RNA, 19 nt, Homo sapiens
uuuccaccagagauauugc

SEQ ID NO: 45435 - RNA, 21 nt, Homo sapiens
uuuucuuuuuuugauuuccaa

SEQ ID NO: 45436 - RNA, 22 nt, Homo sapiens
guugucuuggcaagcaguuucc

SEQ ID NO: 45437 - RNA, 17 nt, Homo sapiens
cccucugucucuccugc

SEQ ID NO: 45438 - RNA, 18 nt, Homo sapiens
uagaaucagagugguggc

SEQ ID NO: 45439 - RNA, 17 nt, Homo sapiens
ccaggcuccagacugcu

SEQ ID NO: 45440 - RNA, 24 nt, Homo sapiens
cuccuuuuccccgaaggguuccgg

SEQ ID NO: 45441 - RNA, 21 nt, Homo sapiens
gggcugacgggggaagcuggc

SEQ ID NO: 45442 - RNA, 17 nt, Homo sapiens
gggcugggguuggggcu

SEQ ID NO: 45443 - RNA, 20 nt, Homo sapiens
gugacuccgccugcagcgcc

SEQ ID NO: 45444 - RNA, 21 nt, Homo sapiens
uccgggaauuccucgacuucu

SEQ ID NO: 45445 - RNA, 23 nt, Homo sapiens
ucuuggauuuuguugaaaucugu

SEQ ID NO: 45446 - RNA, 18 nt, Homo sapiens
acgccaggugcggcaucc

SEQ ID NO: 45447 - RNA, 15 nt, Homo sapiens
aggcggucaccgagg

SEQ ID NO: 45448 - RNA, 19 nt, Homo sapiens
caggguccugacccaggcc

SEQ ID NO: 45449 - RNA, 17 nt, Homo sapiens
cagguaggccagcuccu

SEQ ID NO: 45450 - RNA, 17 nt, Homo sapiens
ccuggcauugucaaucu

SEQ ID NO: 45451 - RNA, 20 nt, Homo sapiens
ggaggugagcgagcgagcag

SEQ ID NO: 45452 - RNA, 21 nt, Homo sapiens
ggaucuggaggaggugaacug

SEQ ID NO: 45453 - RNA, 16 nt, Homo sapiens
ugccgaagccaccgcc

SEQ ID NO: 45454 - RNA, 16 nt, Homo sapiens
ugugccucagguccuc

SEQ ID NO: 45455 - RNA, 18 nt, Homo sapiens
caggagauuugaguuuug

SEQ ID NO: 45456 - RNA, 19 nt, Homo sapiens
cccagaagccgcggccucu

SEQ ID NO: 45457 - RNA, 18 nt, Homo sapiens
ccccgaccccgccggccc

SEQ ID NO: 45458 - RNA, 21 nt, Homo sapiens
ggugaagaagggacaggcagc

SEQ ID NO: 45459 - RNA, 19 nt, Homo sapiens
ucuaagguuucacaaaaug

SEQ ID NO: 45460 - RNA, 21 nt, Homo sapiens
ugagcuccguaaguuuguaag

SEQ ID NO: 45461 - RNA, 18 nt, Homo sapiens
acugcauuccagccuggu

SEQ ID NO: 45462 - RNA, 22 nt, Homo sapiens
ccagcagacaguccagauggca

SEQ ID NO: 45463 - RNA, 16 nt, Homo sapiens
gaacccgagaggcgga

SEQ ID NO: 45464 - RNA, 16 nt, Homo sapiens
caaagcacugguagcc

SEQ ID NO: 45465 - RNA, 14 nt, Homo sapiens
agagccaccaaagc

SEQ ID NO: 45466 - RNA, 19 nt, Homo sapiens
gugcccugacuaggcuggg

SEQ ID NO: 45467 - RNA, 17 nt, Homo sapiens
uggccgagugccugugc

SEQ ID NO: 45468 - RNA, 22 nt, Homo sapiens
agacauuuuuguggaauauggg

SEQ ID NO: 45469 - RNA, 19 nt, Homo sapiens
agaguagaaaugaccuguu

SEQ ID NO: 45470 - RNA, 17 nt, Homo sapiens
aucuuccugcuggacag

SEQ ID NO: 45471 - RNA, 23 nt, Homo sapiens
gagcugucaccacagggcgcacg

SEQ ID NO: 45472 - RNA, 17 nt, Homo sapiens
gcagaggaacuggugaa

SEQ ID NO: 45473 - RNA, 23 nt, Homo sapiens
guggguugcagaggaacugguga

SEQ ID NO: 45474 - RNA, 17 nt, Homo sapiens
cuccccccuccaguucg

SEQ ID NO: 45475 - RNA, 21 nt, Homo sapiens
gcaccccucccauuucccucg

SEQ ID NO: 45476 - RNA, 23 nt, Homo sapiens
gggcccggcccgccggcggccgc

SEQ ID NO: 45477 - RNA, 15 nt, Homo sapiens
uuuugcaccccuccc

SEQ ID NO: 45478 - RNA, 23 nt, Homo sapiens
acagcuuuaaaguucaaagcagu

SEQ ID NO: 45479 - RNA, 22 nt, Homo sapiens
acgugcauguggucaggaguga

SEQ ID NO: 45480 - RNA, 18 nt, Homo sapiens
agagggcguguggucugc

SEQ ID NO: 45481 - RNA, 21 nt, Homo sapiens
caaccugucacgugccaacag

SEQ ID NO: 45482 - RNA, 18 nt, Homo sapiens
cacgugccaacaggugcc

SEQ ID NO: 45483 - RNA, 17 nt, Homo sapiens
caguaugcacacacacu

SEQ ID NO: 45484 - RNA, 16 nt, Homo sapiens
cauggggcagggagaa

SEQ ID NO: 45485 - RNA, 17 nt, Homo sapiens
cccuugagcccugggag

SEQ ID NO: 45486 - RNA, 18 nt, Homo sapiens
gaaagagcagcagagagc

SEQ ID NO: 45487 - RNA, 19 nt, Homo sapiens
gaacccaggcgccgcccuc

SEQ ID NO: 45488 - RNA, 21 nt, Homo sapiens
gcaauggcugaaaucgguguc

SEQ ID NO: 45489 - RNA, 16 nt, Homo sapiens
gccaagcccaccaggg

SEQ ID NO: 45490 - RNA, 17 nt, Homo sapiens
gcccugggaggagcagc

SEQ ID NO: 45491 - RNA, 19 nt, Homo sapiens
gcugaaaagaggggcccug

SEQ ID NO: 45492 - RNA, 21 nt, Homo sapiens
ggagaaagcaguggcagacag

SEQ ID NO: 45493 - RNA, 22 nt, Homo sapiens
gggcguggaggggcccugcacc

SEQ ID NO: 45494 - RNA, 20 nt, Homo sapiens
ggugucaccuccuggccauc

SEQ ID NO: 45495 - RNA, 22 nt, Homo sapiens
gugcagcuuugcucgcugugag

SEQ ID NO: 45496 - RNA, 18 nt, Homo sapiens
ugagacccugagcggacc

SEQ ID NO: 45497 - RNA, 16 nt, Homo sapiens
ugccuugaacuuggcc

SEQ ID NO: 45498 - RNA, 24 nt, Homo sapiens
uggcccuaggcucaaaggagaggg

SEQ ID NO: 45499 - RNA, 20 nt, Homo sapiens
uguggaggaagggcaugggg

SEQ ID NO: 45500 - RNA, 22 nt, Homo sapiens
uuuacauaagugagccacauac

SEQ ID NO: 45501 - RNA, 19 nt, Homo sapiens
aaaacauacauuuucccaa

SEQ ID NO: 45502 - RNA, 18 nt, Homo sapiens
caaaaugaaucuuuuaca

SEQ ID NO: 45503 - RNA, 15 nt, Homo sapiens
cgaaacccgcuucac

SEQ ID NO: 45504 - RNA, 20 nt, Homo sapiens
gaauguccuguggguagggu

SEQ ID NO: 45505 - RNA, 16 nt, Homo sapiens
ugcugggcucagagcu

SEQ ID NO: 45506 - RNA, 21 nt, Homo sapiens
agaggagacagucggcucuaa

SEQ ID NO: 45507 - RNA, 22 nt, Homo sapiens
agagggaaggagggggcuggag

SEQ ID NO: 45508 - RNA, 23 nt, Homo sapiens
cguccuccucuuccucuucccuc

SEQ ID NO: 45509 - RNA, 20 nt, Homo sapiens
gcucccucccucuuccuucc

SEQ ID NO: 45510 - RNA, 22 nt, Homo sapiens
gggaaggagggggcuggagaag

SEQ ID NO: 45511 - RNA, 20 nt, Homo sapiens
uguaacuguguauggcaaaa

SEQ ID NO: 45512 - RNA, 21 nt, Homo sapiens
accugcccagcugccaccacc

SEQ ID NO: 45513 - RNA, 16 nt, Homo sapiens
cccagccccgccgccu

SEQ ID NO: 45514 - RNA, 20 nt, Homo sapiens
cccgccgccuuuucuagccc

SEQ ID NO: 45515 - RNA, 24 nt, Homo sapiens
ccgccgccuuuucuagccccggcu

SEQ ID NO: 45516 - RNA, 20 nt, Homo sapiens
cgcuccgcuccgggccgucg

SEQ ID NO: 45517 - RNA, 16 nt, Homo sapiens
cggcgucgggccgggc

SEQ ID NO: 45518 - RNA, 20 nt, Homo sapiens
cugguuuuuuuucuuuuuac

SEQ ID NO: 45519 - RNA, 15 nt, Homo sapiens
gggcacccggcggcc

SEQ ID NO: 45520 - RNA, 18 nt, Homo sapiens
ucagucuuuuccucuuau

SEQ ID NO: 45521 - RNA, 20 nt, Homo sapiens
cccgcuccucugcgcgcccc

SEQ ID NO: 45522 - RNA, 17 nt, Homo sapiens
ccucugcgcgccccgcc

SEQ ID NO: 45523 - RNA, 18 nt, Homo sapiens
cgggcaggagaaaggcca

SEQ ID NO: 45524 - RNA, 17 nt, Homo sapiens
gcgcgggggcggggcgc

SEQ ID NO: 45525 - RNA, 19 nt, Homo sapiens
ggcggugagcagugccagg

SEQ ID NO: 45526 - RNA, 19 nt, Homo sapiens
gggggccaagcuggguggg

SEQ ID NO: 45527 - RNA, 18 nt, Homo sapiens
ucugugcgcuauguacag

SEQ ID NO: 45528 - RNA, 24 nt, Homo sapiens
acuuggugugugugugugugugua

SEQ ID NO: 45529 - RNA, 20 nt, Homo sapiens
agugaggggagcuugaccag

SEQ ID NO: 45530 - RNA, 25 nt, Homo sapiens
auggcaaugggaaaagcagauggca

SEQ ID NO: 45531 - RNA, 19 nt, Homo sapiens
ugugcguguguguguaaau

SEQ ID NO: 45532 - RNA, 22 nt, Homo sapiens
ugugguuugugugcgugugugu

SEQ ID NO: 45533 - RNA, 18 nt, Homo sapiens
ugugugugugugugugug

SEQ ID NO: 45534 - RNA, 19 nt, Homo sapiens
ugugugugugugugugugu

SEQ ID NO: 45535 - RNA, 24 nt, Homo sapiens
uucugcuucucaucaugggcaugu

SEQ ID NO: 45536 - RNA, 19 nt, Homo sapiens
uuugugugcgugugugugu

SEQ ID NO: 45537 - RNA, 15 nt, Homo sapiens
aaaugguagcuuuau

SEQ ID NO: 45538 - RNA, 14 nt, Homo sapiens
aggaguuauaucuu

SEQ ID NO: 45539 - RNA, 18 nt, Homo sapiens
gccaccaaccuggaggua

SEQ ID NO: 45540 - RNA, 18 nt, Homo sapiens
gggcgucugcucggccac

SEQ ID NO: 45541 - RNA, 14 nt, Homo sapiens
ucucauggauugcu

SEQ ID NO: 45542 - RNA, 18 nt, Homo sapiens
acauuggcuucuccggcu

SEQ ID NO: 45543 - RNA, 19 nt, Homo sapiens
gaugguguagagcaagaag

SEQ ID NO: 45544 - RNA, 16 nt, Homo sapiens
uucccagugccuggag

SEQ ID NO: 45545 - RNA, 19 nt, Homo sapiens
uagcauaaagacaaaaaca

SEQ ID NO: 45546 - RNA, 21 nt, Homo sapiens
uauucuuaucaaaaacagaug

SEQ ID NO: 45547 - RNA, 21 nt, Homo sapiens
ggccaagaccucccagaggag

SEQ ID NO: 45548 - RNA, 18 nt, Homo sapiens
ucccugagucggccaaga

SEQ ID NO: 45549 - RNA, 19 nt, Homo sapiens
ucccugagucggccaagac

SEQ ID NO: 45550 - RNA, 23 nt, Homo sapiens
uguauuuccaucucuccccuucc

SEQ ID NO: 45551 - RNA, 18 nt, Homo sapiens
uguguaauucggagaaga

SEQ ID NO: 45552 - RNA, 17 nt, Homo sapiens
uccuagaagggcaggca

SEQ ID NO: 45553 - RNA, 20 nt, Homo sapiens
aacugguugaaccuccgagg

SEQ ID NO: 45554 - RNA, 22 nt, Homo sapiens
aggcaaggauacuuuaggcagc

SEQ ID NO: 45555 - RNA, 18 nt, Homo sapiens
cccaaauucagagugcaa

SEQ ID NO: 45556 - RNA, 22 nt, Homo sapiens
cugcuugccugcgccccgaucu

SEQ ID NO: 45557 - RNA, 18 nt, Homo sapiens
gcagguguguccgauggu

SEQ ID NO: 45558 - RNA, 16 nt, Homo sapiens
gggaagggaagggggg

SEQ ID NO: 45559 - RNA, 17 nt, Homo sapiens
ugucuuggccaccaggg

SEQ ID NO: 45560 - RNA, 15 nt, Homo sapiens
agcaggugacgucag

SEQ ID NO: 45561 - RNA, 22 nt, Homo sapiens
ccccccggggcagcccccgccg

SEQ ID NO: 45562 - RNA, 19 nt, Homo sapiens
ccgggagaaccuaccacuc

SEQ ID NO: 45563 - RNA, 18 nt, Homo sapiens
gaagggaaacccaagcgg

SEQ ID NO: 45564 - RNA, 21 nt, Homo sapiens
gcccccgccgcaggggcccgg

SEQ ID NO: 45565 - RNA, 18 nt, Homo sapiens
gcccucuggcccgagagc

SEQ ID NO: 45566 - RNA, 19 nt, Homo sapiens
ugcguccagguugcuggac

SEQ ID NO: 45567 - RNA, 19 nt, Homo sapiens
aggcagccuuagcaguugc

SEQ ID NO: 45568 - RNA, 18 nt, Homo sapiens
uagcuggguggcuuacuc

SEQ ID NO: 45569 - RNA, 20 nt, Homo sapiens
ucuguguuacuggacaugac

SEQ ID NO: 45570 - RNA, 16 nt, Homo sapiens
ugccuuaauugagggg

SEQ ID NO: 45571 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 45572 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 45573 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 45574 - DNA, 42 bp, Homo Sapiens
taatacgactcactatagggtgaggtagtaagttgtattgtt

SEQ ID NO: 45575 - DNA, 41 bp, Homo Sapiens
aattaaccctcactaaagggaaagtagtaagttgtatagtt

SEQ ID NO: 45576 - DNA, 40 bp, Homo Sapiens
taatacgactcactataggcccttattagaggattctgct

SEQ ID NO: 45577 - DNA, 41 bp, Homo Sapiens
aattaaccctcactaaaggtttttttttcctgagacagagt

SEQ ID NO: 45578 - DNA, 20 bp, Homo Sapiens
gaggcaggagaattgcttga

SEQ ID NO: 45579 - DNA, 39 bp, Homo Sapiens
aattaaccctcactaaaggcctgagacagagtcttgctc
